United States Patent 10,233,495 (METHODS AND COMPOSITIONS FOR SCREENING AND TREATING DEVELOPMENTAL DISORDERS) - sequence listing, part 118

SEQ ID NO: 621 - DNA, 117792996 bp, Homo sapiens (residues 92,551,691-94,234,448 of 117,792,996)
  misc_feature (358797)..(383796): n is a, c, g, or t
  misc_feature (12480561)..(12530560): n is a, c, g, or t
  misc_feature (13211533)..(13391532): n is a, c, g, or t
  misc_feature (15763259)..(15813258): n is a, c, g, or t
  misc_feature (21949357)..(24949356): n is a, c, g, or t
  misc_feature (39920968)..(39940967): n is a, c, g, or t
  misc_feature (76754544)..(76824543): n is a, c, g, or t
  misc_feature (78946938)..(78966937): n is a, c, g, or t
  misc_feature (106685630)..(106715629): n is a, c, g, or t
  misc_feature (112143340)..(112183339): n is a, c, g, or t
ctatatcacccaagaaaggcattcaggaatgattagctctattccatgttataatatatgaaaaacttaacatgaaggtatgggcttcaaaacagaaattcaattccatatgtatattcgacaagtctctttttataatttttatgaaagagtgctaaaccaaaccttctctaaaaattgctggtatgtcttgggatggtggtagtgattcctgggtcgagtcaaacagtaaaattgaagaattatccgatccaacttgtgaattctttgtaaaatcctgtaaaaatttataattattttgtttcataaacttttatagagataaatttagctgtatgtcaatactataaagaatcttaataactcaattactaatatggtataaaacacaaaggtaattattagtctctgccaaaattagcatctactgggtgaggagtatatgggaactctgcattatttttgtaatttttctgtaaatctaaaattagtttgaaataaaatgttaaaatttaaaaataatattacaggcaaagtagaggttatattttggaacaacttttctgcaaggaaattttagcagtatctatatcaagggctttttaaaaaaagttcatattctttggtccaattattccaattactcaatttctaagaatctatgctaaagaaatgaaaatgtttaatgaagaatgatttataatagcaaaaattgaaaacctgtatgtataacaataaagaaatgactaaataaattaaatgatactatcacataacatcatgtttttgggaaatacccaatgacaaagaacaatgttcccagtacaatgttcagtgaaaaatgaggaatagatatcaaatatatattaatatggtcccctgactgatatactctaatgtcaccctaaccatctacagaaaacgaaaatcaaaatacagtatatattcttccctgtctcttttctaacctatccctccttacacaatacttttataatgaggatataaagattttgcttgcttgttttgtgcttacactttgagagatgattaggttttagactatgacttaattgtaaccaagtgcaatcttaccacaaagtaaatattttctctaaatattttttatttaaaagtttaaaagtggaaaatatccgtttgcaatttccaaaaatagttaacagaagttcctctgaataaaggtaacactttcaaccttttctgaggtgacatctctgataaattaagtaccacaatttcggaaagcagacacattattcaacaaacaacctgttaaataattctccaattgggaatttcttatgtctcataaaatatttcagaaagataacaaatgtaacagtaaggcagactaggcaagaggctgagattcagaagacctgtccatttatttaactatgttaccttgggcaagccacttctgagcttcaagttatttacctttccaactgaaataagagccactaataattatgtatttaaaatgtacttgcctctttcacagtacatgtattttattaatagttgtcataacagtatgaataaagacctaatattatctcacattttataaataggtaaactaaaatttctcgtagttaaggttcccagtacaacccagcctgttacagatgaaggagctggaatcagaactaaggtccgcctgattacaaagcctgtgtccttaagctatatctttaaaagagataataataatactcactttaaaagagataataataatactctccttccctgcctgaaagaactgagatacagataatgaaatagatttaaatttttaaataaaatttccttatgtaggattctcaattcattcgagaatatctgtctgtcattctcaactctggctgcacattacagtcacttggagagttttacaatgtcaacacagtgaagagcacaaatgtctacgacaatagttttaatcccacagatccctgaaagagacttagggaaccgtaagggtacaccactgctctaaggcaatgcttccatttaaaaagtacatacttaatggggctgagtgcagtggctcacgcctgtaatcccaacattttgggaggctgagatggaggatagcttgaggccaggagttcaagaccagcctgggcaacacagtgagagccccatctctaaaaaaaattaaaagccaaattagctgggcatggtggtgcatgcctgtagtcccagctacttaggaggctaagtggaaggatcgcttgagcccaggagttggaggctgcagtgagctatgatcatgctactacattccagagtgggtgacagagcaagaccctgtctctaaataaataaagtatatgcttaaatgtataaatggatgtgtgtatacacatgtttaaaattctgggttaacctggattgaaataccagatccatcatttaccagctgtgtgtccttgagtgaatcatttatcctctctgagcctgagtttcctcaactataaaatgggaataataatagtgcccatctcagctgggcgtggtggctcacgtctgtaattccacactttgggaagccgggggggggcgggtggcagatcacctgaggtcaggagttcgagactagcctggccaccatggtgaaaccctgtctctactaaaaatacaaaaattaactgggtgtggtggtgcgtgcctgtaataccagctactcgggaggctgaggtaggagaatctcttgaacttgggaggcagaggttgcagagagctgagatcacatgactgcactcccacctgggagacagagcaagacaccgtctcaaaaaaaaataaaataaaaaaataaaaattgtgcctacctcataaagatgccataagaattaaataagattagcacaaagacttgtacatattaacaggccagtaaatgttaagtattatcattatctattacttttattaaaagtttttaaagctaaactatgaaagtatgatttcagaataagcaataatgacttcagaacactctttccaatttaagaacacttgttttagtttattaacttaaaaatgtggccattatgcattattcatgttgcaatacattttagttttttattttgttgttgtctttttgagatggagtctcactctgttgcctgggttggagtgcagttgtgcgatctcggctcactgcaacctctgcctcccaggtttaagcaattctcctgcctcagactcccaaacagctgggactacaggcatgcgccaacacgcctggctaatttttttttatttttagtagagacggggtttcaccacgtttgccagactggtcttgaactcctgacctcaggtgatccacccacctcggcctcccaaagtgctgggattacaggcatgagccattgcgcccagcctttattttttttattaaatagagacagggtttcaccatgttgctcaggctggtctcgaactactgagctcaagcagtccacctccttcagcctcccaaagtgctaggattacaggtgtaagccactatgcccaacctgatcatactttttcactcatatttagatagtatagttttcaatactgtatttaagcatattagctgatttattaatatgttggacaattcctgcagttattattttgggttttggttgagttatatcataaagatggggattatttttctactgaaatggtaactagctatgacagttcacaattttttgggtttgtttgtgttggcttttgtttttttcttgaatcaggatctcaccctctcacccaggctggaatgcagtggtatgatcttggctcactgcagccttgacctccagggctcaagcaatcctcccatctcagcctcccgagtagctgggactacaggtggtgcaccactatgcccagctaattttttgtatttttgtagagatgtggtcttgccatgttggccaggctggtctcgaactcctgggctcaagcgatctgcctgccttggcctcccaaagtaccaaagattacaggcgtgagccactgtgcccggctgacagatcacaattttaactcagtattataatagccaatgtgtccctgaattaattgtgtaattttataaacacttacaggtttagacgcattctcaacagtaacagagctttgtgaagatttagatacaagatgaaatctaggcgaggcagccactggatttgatggtgggtctctgcagcgttgacttgcagtcctgaatatttcaggaatacctgtattttaaaattatacaacatattgaatatatttctatacaaccaattatatcaaaatatttaactttaaaattgaaatactacagtaatactgtacctggactgtgtggctcactctttattccttttgaagatgagctggagtggcctctgttcaaaatatctataaaattatatttattttaaaatttgttatgtgaatgaaatatatactaatagaaaaattcctccaaaaacatatctttgcataaccaataattgaagtatatttctttcctttaatggtgacagggttgtgtacagattctgattcccgtgacttgaaatcaaacccttccccaaccctgtgccacattcacacctctaaaaatctggaagtttcatgatgggagggctgactggattaactttctgtaccattactcttgagttctgaataggaaattatcagagactacagactaaattaaacctggagttccagagtatctgattagactaaattaaacctggagttccagagtatctgattaatgtaaggggtttcaaatctattactacgctagaagtcagtttgagcctcacaaaaccctctggatcggtttaagactgcacacccttgtacccatatgaactccgtaacttctaggttactgaggagtcaaattgaaatttggaagaatagtgatttgcttaaaattgtttatcaggaaaaggcacaaagcattaacaaatcccataaaacctcaaacattttccttttttctctcctagtagaaaagaaccagatcccggccaggcggggtggctcacacctgtaatcccagcactttgggaggccgaggcgggcagatcatgaggtcaggagatcgagaccatcctggctaacatggtgaaaccctgtctctactaaaaatacaaaaaaattagctgggcgtggtggcaggcacctgtagtcccagctacttgggaggctgaggcaggagaatggtgtgaacccgggaggtggagcttgcagtgagccgagatcgtgccactgcactccagcctgggcgacagagcgagactccatcttaaaaaaaaaaaaaaaaaaaaaaagagagaaaagaatcagatctcacaaaacaattctattaagtgaagggtcacaccaaagtagggttgctttctgatcatagaaatgcagtactctatgagtaaacattacggaagtcttctaaaagaaaaatatcctcaaacaacttgataatgttttcattcagaaattcaagataagtattactcaatccactaagagctatttttacttgttggtggttatagtctaccaatcacaagttttttgctctccttcccctgccttcattgtttttctatataaacatttagatgagatcccatatgctaaaatattttatagctcacaaataaaacatcaataaaatcacttaaattctaagttatcaatatagaaaagaaattctagtgggcccaataccctttttgatagaatctcttgaaacgaatacacattgttttggttgagtactgctaagtcatctacaatcaatataaatccaacttgaatcttgtcatgcttcaataagatgatttgagtaataattttgaaatatggtaatatttcagcataaaaattgtcacagtgactagaaataataagagaatattctattctactatcaataataaatatgccaaatatatctagctcatttaataatttaagtggctctccacttagaacctcccaatttgccacaggaaatgatactgagaattcaattggctaaattattctgcctctgataaaactgagtagaaatgctattccaagtttagagccaagagaagtaagaactaggatttcagaaaatttaaaactcatctcttaaccacactattactcattgccatggtaagaaagaagactggtatgctggctacattccttgacttctccaggcctaaaataagtaaataaaatgaaaaaggatctgtttccctctttctctcctgaaattcagttatgttgtcccttgcactttagacatatttgaggactttttttttttctttttttgagatatagtcttgctctgttgcctagactggagtgcagtgacgtgatcttggctcactgcaacctctgcctacaggttcaggcgattctcatgcctcagcctcctgagtagctgggactacaggcacgcgccaccatgactggctaattttttaatctttatagtagagagggggtttcaccatgttggccaggctggtctcaaactcctggcctcaagtgatgtacccacttcggcctcccaaactgctaggattacagggaggagatattttattttaataaacatcaccagtatcttcactttaacattgtaataatgccaagtctaattactctaacagaaatctaacaatccacaaaggtactggacatgttttgctagaaagccaaaaagatttacgtgtgctgactgcctgcattgtccaagtatagtgttggaaaaccaggccctccctccttcatgaatataaacagtagttgcggaagatgggtgtagccaaaggctatagcacatgctggtagacagaccagagattctataatcatgcagcacctatgcattttatagtcatatatcaagatgatactttgatgaggcagttgcttagacattagaacccccatcagacactaacacaaacttatttagcatatcaggatattttaagaaaagtattccaaacacttccttttctgtaaatctgagtttaagggagaaaaaaaaattaacaaataaataggctacttggttccattaaaaattatgatttccaatctcagaaggcttacaatgctgttcaggtcatcttaaccctcaattaacttagttatttccttttgctcacatctgatattttaacctttcacctccttactccagtccccaactacattcccgctttgattctcacaagttcttactgacctttactctccctcttacctctaactccttacagaagaacaacagtatgaaggacagatatctcatatattttccattagaaacaaccatcttatgaaacgttacttcactgaaagtaaatgcttacttgaaatggctggttttgaacttgatatctctccaacaaagatcagttcatcgtcatcctcatcctgagtttcttctactttcttctgccatggctctagctcttcttcttcacattccataaagagttctgccatttttgaaatgtctaattttcaagagaagagaagctaactttattttcaaagagaaaaatattttctgtgcaatacatagtatgatatttaagatgcactgtaataatcctaatagcaattactgacttgatatttgtttgtttttgtgacagagttttgcttttgttgcccaggcgtgatctcggctcactgcaacctccgcctcctgggttcaaacgattctcctgcctcagcctcccaagtagctgggactacaggcgcccactgctacgcccagttaatttttgtatttttcgtagggatgggtttcaccatgttgaccaggctggtctcgaactcctgacctcaagtgatccgcctgcttcagcctcccaaagtgctgggattacaggcatgagccaccatgcccagcctactgacttgattctcgtgcctcagcctcctgaatagctgggactacaggcatggtctacagtggaccctcccccaccctgagcggccatctctgccttgtaatcagtacatggtagcaaaagaaatgagctcagaactaaatctctaagatctaaaccagttaaacttggctagacagatagataatgaaggatagtagtcatttacagtggccaatacattttaggatcaaatccaaagtgagttttagttataggactaggatgattatatctacaaaaaagactgtagctattatctgaaaaaaaaattcacttgtataaacaagggagataaactaagaataagagaaaatacataggagatatactagaaaaacggaaccagattcaggtatatcaggcacagggcaaagcaggcatgaggtactagactgaaaatagggaaattaagtgaaacttaattctgtttcaggacagattagacatttctcatttgaagaaactaagtaaaaaatatactgtgaatatcaccagcctacaagttctgacccaaatcagatctcctgggaagcattttagtgcctcactcttaaatatgggtggacaaccaatgcgtaccagaaaattgaggaaaaccttcaatgtgaaacaccaaagcaataaaacagattaaaggattttaaagaaaaccgacagccaggcaggatggcaaactagatacagacaggtggaacagctgccaccgagggactgggacaactggtgcactcttaacacatcttcaaaggggaggtgctgagtgggctgagggaagacacagaagctagaatgaagcgggaggaaactgggaagcctgtatggggctactgtgcacctggattggttcctggcccccaatgactacgggggaatgggtgagttgaactggcaaggaacaactcactcttgccatggacctctgggaatcccggcaggagaagaccctttgatcaccactgacactttagttggcagggagagctgcttagagaagtggtagaggcagcacacgagccagagtggagcccagagggtttgttgcaggaacatctgtattcaagcacagcctgggatgcccatccccctaggctctgcttgtttccataggagactgtagcactaggggaactgtcagacctgaactctgcagggtggtcttgcccatctgacctgagcactctttggtcagctgtcctctcctggagccccagtctgcccattccctcttgcagtacagcctagagtgccctgatggccagcatcatagctcctgagctggccaaccgggcttgaccagcggagagctccagcagggttgcccctgtggccatgcactggcccacctgctcattctccccactccagcttaccctgggtccatggccaccctccacatcactttgccagtcagtgcgtatgtgcgcaagtggatcttgccttccctgccccgtaagaacatatgtgtatgtgcaccctgccctgcctgctgccagtgggagtgcactccgcccaccctcctctgccatactaccattgtagtcggagccttggtgagcacagagcccgcaagacctgtgcccaccagcaccctgcccctgagccaccactgccactagaatgtaactacgcacagagaacagtggaccctcccccaccctgagcggccatctctgcctgtatcaacatgtacaaagagtgcatacagtcctgcaacggccagtgccccatccccatgctaatgccaccaccagcatgaccatacacacagttgccacctggggcccctgcacccctgagccatgctgcctctgccacttctgcgaaagcccacgcagaagccactagcaccctgcagcagctgatgagtgtgcactctgctgtgctgctgctgccactggcatgtgtgaacaagaatgggccctgctgtcactgccctacaaaacagtttggctggcatcacccattggcgtgctgggacaagaggtccacgagcacctcagtccccctagcacagtgagttcctaaccttgagaagccagagaaaaaagcagaggtccaatatcagtcctacaaaattagagcatgcactccaggagttgtaagctgagccttggccccctaaaatcttctagaaatgaagccagttgactgaatctaccttataccacaatcaaacccttaaggtcatcaggtagaagaaaaaaataatccaaaggacagtgacttcaaagactgaaggaacatcagcccacaaagaagagaaagaaccagcaaaagaactctgacaactcaaaaagccagagtgccttctttcctccaaactgcattcactctccaacaagggttccgaagggggctgagatggctgaaaggacagaaaaaagaattcaggatatgaacaggaataaaggtcactgagatgcaggagtacactgaaacctaatccaaggaagctaagaatcatagtaaaacaatacaggagctgatagacaaaatagccagtatagaaaagaacgtaactgacctgatagagctgaaaaacatacaagaatttcaaaatgcaatcataagtattaatagcggaatagaacaagcggaggaaagaatctcagaacttgaagactggttttctaagatagccaaaaaaatatagagaaaaaagaatgaaaaggaacaaacaagacttctgagaaatatgggattatgtaaagagaccactaaacacccacatcaaaaagacagatctcaatttaacatcctaccatgacaacaaaaagaactagagaaccaagagcaaaccaattccaaagctaagagagaagacaagaaatgtccaaaatcagagctgaactgaaggagattgagacaagaaaaaccattcaaaagatcagtgaatcagggagttgttttttgaaaaaattaataaaataggccactagctagactaatacagaagagagaagatccaaataaacacaataagaaacaacaaaggagatacaacaactgaacccagaaaaatacaaataaacatcagacaatattatgaacacctctatgcacaccaactagaaaatccagaaaaaatgaataaattttgggacacattcactctccccagactgaaccagaaataaactgaagccctgaatagaataataacgagctctgaaattgaaccagtaaaaagagcctaccaatcaaaaaaaggtgagaaccagatggattcacacttgaattctacaagatgtacaaagaagagctggtactattcctaccgaaagtccttcctaactcattctatgaggccagcattgtcctgataacaaaacctggaagagacacaacaaaaaaataaaactttgctggatgcggtggctcacaccagtaattccaacattttggaaggcggaggtgggtggttaacttgaggccaggagttcgagaccggcctggataggtaacatggtgaaacccccatctctactaaaatacaaaattagccagggtgatggtgaaagcctgtaattccagctacttgggagtcagaggcagaagattcacttgaacccaagaggcagaggttgcaataaggtgagatcacaccactgtactccagcctgtgcgacagagtaagactgtctcaaaaaaataaaataataataataataataaagaacagcttagccaggcatgatggcaagtacttctttcccagctactcagaatgctgaggtgggagaatcacctgagccccaggagactggggatgcagtgagccatgatggcaccactgtattttagtctaggcaaacgcagtaaggacctgtctcaaaaaaaaaaaaaaaaaaaaaaaaagaccagcaatattatacaacatttccctctcattcaccctttctttctcaggaagaatccaccaaaacgagacttaagaaggaggacaatgcaggatgcagaaaatctgacattcggcacaatacaaaaacaaaagaaaatcccaggacaacagctgtgcagtaggtctacagagcaaacagccagagtagcgcaggagaatatcatttccaggagaccagccaatcttccaaagtattaagcattaaattgttagataacctgacaagtttcacagtgtaacaaaagtgaattaagaggccatggggccgggcgcggtagtggtgcatgcctgtagttccagctacccaggaggctaaagaatgagaatctctggaacccaggagagaacgagaatctctggaacccggaaggggaagtgcagtgaactgagatcgaaacactgcactccagcctgggaggcagcgccagacttcgtctgaaaaaaaaaaaaaaacaaaaacaaaaacagaggtgacagaaggagccaggcgtagaggctcacgaccttaatcccagcactctgggaggccggggtgggcggatcacttgatgtcaagagtttaagaccagcctggccaacatggcgaaaccccgtctctactaaaaacacaaaaattacccaggcatgatggcgcacacctgtaagcccaactatttgggaggctggggcaggggaatcgcttgaacccaggaggtggaggttgcagtgagctgagatcgtgccactgcactacagcctgggtggcagaatgagacgctatctcagaaaaaatgaaaaacaaaaaacgaaaaaaccaaaaatcaaaaaaccaaaaagctttcatgccaacatctttgatgaacatggatgcaaaaatcctcaacaaaatattggcaaaccgaatacagcagcacatcaaaaagcttatctactactatcctgcaggctttatccctgggatgcagggttcgttcaacacatgcaaatcaataaatgtgattcatcacataaacagaactaaggacaaaaactatctgattatctcaatacacgcagtaaaggctatcaataaaattcaacaccccttcgtgttaaaaatactcaataaacggtcaggtgtggtggctcaggcctgtaatcccagcattctgggaggccgaggtgggcggatcacgaggtcaagagatcaagaccatcctggccaatatggtgaaaccctgtctctactaaaaataaaaaaattaactgggtgtggtggcgcgtgtctgcagtcccagctacttgggaggctgaggcaggagaatggcttgaacccaggaggcggaggttgcagtgagccaagatcgtgccactgcactccagcctggtgacagagtgagactccgtctcaaaaaaaaaaaaattctcaataaactaggtattaaaggaacatacctcaaaataataagggccatctatgacaaacccacaggcaacatcatacagaatgggcacaagctggaagcattcccctggaaaaccagcacaagacaaggatgctctctctcaccgttcctattcaacacagtattggaagtcttgactagagcaatcaggcaagagaaagaaatagacggcatccacataggaagacaggaagtcaaactatccctgtttgcagacagcatgagccaatatctagaaaaccccatagtctctgcccaaaagtgccttaagctgataaacaacttcagcaaagtctcaggatacaaatcaacgtacaaaaatcaccggcattcctatacaccaacaacagtcaagccaagtgccaaatcaggaacacaatcttattcacaacagctacaaaaagaataaaatacctaggaatagagctaaccagggaggttaaagatctcttcaatgtgaattacaaaacactgctgaaagaaatcagagatgacacaaacacatggaaaaacattctacgctcatgaattggatgaatcagtattgttaaaatggcatactgcccaaagcaatttataaattcaatgatatgcctatcaaactaccaatgacattcttcacagaacaagaaaaagctattttcaaattcatatggaaccaaaaaaggcctggatagccaagacaaacctaagcacaaagaacaaagatgaaggcatcatgctacctgccttcaaatggtacagggctacaataaccaaaacaacatggtcctggtacaaaaacacatatataaaccaatggaacagaatagagagcccagaaataaggccacacacctacagccatctgacgttcgacaaagctgacaaaaacacacaatggggaaaggactccctattcaataaatggtgccaggataactggctagccatatgcaagagactgaaactggaccccttccttacaccatacacaaaaatcaactcaagatggatcaaagacttcaatgtaaaacccaaaactataaaaaccctggaagacaacctagccaataccattctggacataggaatggccaaagacttcatgacaaagacgtcaaaggcaattacaacaagagccaaaattgacaaatgggctctaattaaatgaaactatagacagagcaaaagaaactagagacagagtaaacagacaacctacagacaggagaaaaattttgcaaatcatgcatctgacaaagggctaatatccagcatatataaagaacttaaacaaatttacaagaaaaaagcaaacaaccccattgaaaagttggcagtggatgtgaacagatgcttatcagaagaagacatacatgcaggcaacaagcatatgaaaaaaagcacaacatcactgatcattagagaaatgcaaatcaaaaccacactgagatataatctctcacctgtcagaatggctattcaaaagtcaaaaaaataacagatgctggggaggttgcagagaaaaaggaacatttatacactgttggtgggagtgtaaattagttcaaccactgtggaagacagtgtggtgattcctcaaagagctaaaaacagaactaccattagacccagcaattctattactaggtatatacccaaaggaatgtaaactcttctatcataaagacacatgtatacatatgttcactgcagcactattcacaggagcaaagacatggaatcgacccaaatgcccatcaatggtagactggatgaagaaaatgtggtacatatacaccatggagaactttgcagccataaaaaagagcaaggtcatgtcctttgcaggaacatggatggagctggagaccattatccttagcaaactaatgcaggaacagaaaacctaataccacatgttatcacttataagtgggagctaaatgatgagaacacatggacatatagaggtgaacaacagatgctgagggcctacttgagggtggagggtgggaggagggagaggatcaggaaaaataactcatgagtactaggcttaatacctgagtgatgaaataacctatacaacaaacccccaagacatgagtgtacccataacaaacctgcacatgtatccctgaacttaaaataaaagttaaaaaaagaagacacagataatacagagcaagagacaataataggatataataaacatctttagacagataagacaacgatattatataaagacagccaaaattcagttaaaaaaaaaaaaaagtcaaatgtcaaagttgagtaaatgtgaaaccaaaagacaaaaaacacatatattaaacacagaaaacaagattggtagaaaaatcattttctttttttttctttttttttttttttttgagacggagtctcgctctgtcacccaggctggagtgcagtggcgggatctcggctcactgcaagctccgcctcccgggttcacgccattctccttcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgaaaaatcattttcaaaggtataaaatgcacctaacaaaagctccagaaaaaaaaaaaagagagagaaaaaggagaggagaagtaatcaaaggaaaatacaaaaaaaattcctagttctcatggatataaatctacagaaagaaagggcccactaacagccagcacaatgatcaagaataaaaactacactagcgggacatatgaaatttcagaatatcagaaattgccaggtggctgagtgtggtggcccaggcctgtaatcccagcactttcggaggccaaggcaggtggatcacttgaggccaggagttcgagaccagcatggacaacatggtgagacgctgtccctactaaaaatacaaagattagctgggcatggtggtgcgcacctgtaattctagctgcttgggaggcagaggcacaagaatcgcctcaacccaggagccggtggttgcagtgagctgagataggaccctgccactgcaatctagcctgggtgatggagagtctcactcaaacaaacaaacaagaataaagaacagcttagtcaggcatggtggtgtgcactcaagtcctagttactcagaaagctgaggtgggagaatcacctgagctccaggaggtggggctgcagtgagccatgaaggtgccactgcactccaatctaggcaacagagtaagggcttatctccaaaaaaaaataagaataagaataaagaccagcaatattatacaacatttccctctcattccccctttcttagtaggaatccaccaaaacaagacttaagaaggagaatggcacaggatgcagaaaatctgacattgagcacaatacaaaaacaaaagaaagtcccaggacaagagctgtgcaggagaataccactcccaggaaggtgccaatccccctaaatattattaaaatattaaacattaaattgttagattacctgacaagtttcagtgcaggaaaagtgaattaagaggccatggggccgggcgcggtggtggtgcacgcctgtattcccagctacacgggaggcagaggcagaggcatgagaatcgctggaacccgggagtgggaagtgcagtgagccaagactgcgccactgcactccagtctgggcgactgggagactccatctcaagaaaaaaaggggacaaagaagtgggggggcgcggtagctcacgaccttaatcccagcactttgggaggctgaggtgggcagatcacttgaggtcaggagtgtgagaccagtgtggtccatacggcaaaatcctgtctctactgaaaacaaaaatacaaaaatttgcagtgcatggtggcgcacacctttaatcccagctaggcgggaggctgaggcaggagaattgctggaacccgggaggtaaaggtgcagtgagttgagatcacgccactgcactccagcctggttaacagcgtgagactgtctcagaaaataaaataaaagaaagagggccaggcgcggtggctcacacctgtaatcccagcactttcggaggccgaggcaggcagatcacggggtcaggagatcgagaccatcctggctaacatggtgaaaccccgtctctactaaaaacacaaaaaaattagccaggcatggtagcaggtgcctgtagtcccagctactcgggaggctgaggcaggagaatggtatgatcctgggaggcagagcttgcagtgagccgagatcacgccactgcactccagcctgggcaagagcgagactctgtctcaaaaaaaaaaaaaaaaaaaaaggctctggaagggtgtgagtggctataggttttaataaactttgctgacttataaaatgaaaattttaattggacaatacatagaaaaagagaaaaggaaatgtatccatcataatacattaatacagtaccatgctcacccgtgaacagtattacggtcatcataaaatcactgaatatgatttactgaaaaattcagatataactatattgagagatgcttaaaaggaagaaaaagctttaagaaaaccaaaatcctcatcttccttgacagaaaatcactaggtaatggcaaaacttgatgattcaagagacaacatatgtacatatgagttttaaaaattgagaaacgtggaattattagaaaaacagctatacaactgaaagtacatgctttcagttttttagcttgaaaaaacagggagtatataggtacctgcatgtgctcacacatacacacctatctctacctctctctctctccttcactccctcccttcaagagactgtgcttaagtaacttaaaggcttttcaagttgtttgactttaaaaaaagataagtgtattgtttaggttaaaaaatagtgaaggagatgtaaactaatgtaacagcaatggggtctgggcacagtggctcacgcctttaatcccagcactttggtagactgagatgaggccaggagttcgagaccagcctggccaacatggtgaaatctcgtctctactaaaattacaaaaattacaaaaattagctgggagtggtggggcacacctgcaatcccagctacttgggatgctgaggcaggagaatcacttgatcctgagtggcagaggttgcagtgagcagagatggcaccactgctctccagtctgggccacagtgctagactctgtctcaaaaaaataaaaaataaataataaataataaaaatgggaatgtatataagtggtggagtgacatgtggattgtcggggacaactataagaataaataaaaacaaaataaaacttcttcagggttctggcttagacaatgatatctttgtttttcaaatgcagtcattcctaacagtaattttactatattaaaataatgccatttctacttttgactcaaaattaaggccatcctttagcatggccttaacatgtaaaacttgaaaacaatgatttgaggacagtacacaaacaaaacctcttaacaaattggttccattcttttaaaacattttgatttcctcttctatacagatatgccagatatcatggcttggcataacattgtttgatgttcagtagtctgcctaccaaacaaagaaacccccaaaacaaaaaatcttcaaattctcccaaatgtaaccaatattatgaactgacccttttttccaaatacctcaaaaaacattacatagaatgttgtaagtcagacaattaaaagtattaattcatatttcagtatttgtatattctgaatacttgaaaataccgcactcattgtgtcctttgaagtcctcattcgtactgcttcttccacctggaataccctttctccttaccttatactgtccacatcattcgagtatagtggaaagagcatgcacttgacatcaaattgaatagttcaaatcctcactgcaccatttttaattatgtgactctggagaaattacttgaatctattttctcacctctaacatgagcacaatatctacctaatagaagtggtaacagagattcaggaaaatgccatattaataagtatctaacttcaaacagatatccccccaaattgattctttgcccctttccaactcttagttcaattataacttcctcagcaaaccattagatttgtttttctttaacctcttactgcactgacagtctatgctatgcaattcaagatttaatatatatgatctcaaactgcctatttcttagtgtgccttaattatacatgttcaactccaaagtaagctccttgagagtgaaaaacatattttctttctttgtatttcctcctacacacagtagtgtattggatatgtagtaggtacttaacacatgattatctatggggtaagaaactaggtaaagccaggcaatgccagatttaaagaaacaagggagactcatatatactgatgattgaaaaagtaatttacattcatgttgacaccactgtgatattatgggaacaaataaataggtcttccccattcttttaaactgagtactgtcattgttaatttcaagatatgctaccgagcaaaaaattttaaaaggcacataataacatatatagtatgatcttatttagaaattattttttgtctatgcacagaaaaaagtttgtgattatgtatactaaacctacaacagtagttatcgctggggatgagaaggaaacatttcatatctattactgacatgtttactgtatttttttttaaactaggaatatgtattactttaataaatatttgttttggccaggcacagtggctcacgcctgtaatcccagcactttgggaggccgatgtgggtggatcacttgaggtcagttcgagaccactctggccaacatggtgaaaccccatctctactaaaaatacaaaaattagccaggcatggtggcgggtgcctgtaatccaagctacttgggaggctgaggcatgagaattgcttgaacctgggcagcggagcttgctgtgagccgagatcacgccactgcactccagcttaggtgacagagtgagaatctgtcttaaaaataaacaggccaggtgcggtggctcacgcctgtaatcccagcactttgggaggctgaggcgggtggatcacgaagtcaggagattgagaccatcctggctaacacagtaaaaccccgtctctactgaaaatacaaaaaattagctgggtgtggtggtgggcgcctgtaatcccagctactcaggaggctgaggcaggagaatggcgtgaacccaggaggtggagcttgcagtgagctgagatcatgccactgcactccagcctgggcgacacagtgagactctgtctcaaaaaaataaaaataaataaataaataatatttgtttttaagaaaatgtgcccacttctgtctctaatcttttcttttgaaaggtttacagtacaaaaaccatgcctattagtatcaactacagcagaaatacttactttttggttgaaaaggtttgtcgtcatccatgaagttgcaaggtcacctaagtacgaacacatgacatcaatcaatgttatgagtcactttaagtaacaccaagtattgaaacatgaaacctgagatccaaaatctttgggtctaattttgatctccagcacactcaccatatgactccagacaagacagtaagctaggtctcagttttccaccctctaaaataaagatgtctactactagtgtggattttgttaaattaaatgcacataaatttagtctttttctcctacaaaagcccaccttttgagtttgatatgtttaatacacacaggtaattcattttccataattggttcatttccaaatgaatacatttaacatatagttaaatgtattaaacatttactacttgaaaaaatcggagttatcagattacaaataaacttcaaaagggatctttatgcaaaaatgagtaattatcctgtaatatatgttttagtaaatctgaattctgaaatgctaagtgacattaatctttaactgattcctattcttcacatttcagaaatattattactataagaaaacacatacatttagatatttttagttttttgaaaagtaacagaaaagtaattggataaattgcgtagtaaaacaattcattataaagtaactgttcattgccttttgtgctcagggtagtatgccaagttctagggaaaatacaaagatgaataagccatagtccttgccttcagaagtttacaatccgtctacggttctttgggcttttcaaaaagctgttacattaaacgttatcaaaaaaaatgtgaattgctttctaaaacaggaatttgtatcctgagttctcgtgcactgaacataccatatattctacatacagaataaacttttaaaatactatttaagttataaaacaaaaaaggtaaaaatcagacatcagaaatctaaagtaggatatacagagctaattcagtctccacatttgtctttatcttccaactggcaaaagcaaactccctaattccaaattatttggacggaattagagcaaaggggaaaatattactttaactccaaaagaagttacttgtataaatgtttggatttctactacaagagtctctagtgaattctgtaattcagtaaatgtccctagttttgaggtctgactattcaaatctctttaaactcaactacttggatagttagtgcttgttcctaaattagaattaaggtaatacatatgccacgcagataaatacatgaccattcttgctcaacattaaggatctattgctaccaagagcacagaattttttaaagtcacaattgcacagcctatgagattcatataacactttttttttttaatttttatgttttagagacaaggtctcactatgttgcccaggctggagtgccgtggctattcacaagcacgactcatcatcgcataccacagccttgaactcttgggctcaagtgatcctcccaagtaactgggactacaggtgaacatcactgtgcctggcttaacactttaattaaatgatcatataaaatatttattggcataaccatcctaaaatgattactaaatgtacaagtagtctatataaacaagtcatatttactgcctatggctatagagatagcttttgaggcccaatgcagccaccaaagagtctcaattggtacgctcataaatgctctaaaaagtcagaaatctttagatgccattagagccataacttcagtccaaagctgtgctatccaatgaggtaaccactagccacatgtggctacttcaacttaattaaaaaataaaaatccagctcctcagtcactctagccatatttcaagtgctcaaaagctacaagtggttagcgactactatagtggatgatgcagctatggaatttctatgggacgacacgtcaaaagaatactaccatacttagttccagtttttaaaataaacaaatacatacaacttcatggattcctttggggaaggattgcagccttctaaaactatcacaaaaacccctaaagtcaccacatcagaattttggtggcaagggaaggaattgtatgggggattaagtcagctgtcagagaaatggaatatccagcaaagatatgcagtgggcatcttaagagctcctataatagcaactccagagggtctctaggttctgcaactcagagttggcatcaaaataggcacaagaggaaagaacaccccatatttcagctaccgattcaggtggagacactatacccatgtttaatacactgttcttctgagggaaaaaaaatgaattctgagtaactgactgaggaaacacctactgaacacaacccattcatttttttgaagactgcctgtataaataattataattcctatttattttttggtttcagcttttatgtatctaaaattcaactatgttttacaagagtttattctacaaaaagttaaaaatagattgacatagttaaaatggtaaatagtatatgtattttgccacaataaaaaaacatttaaatagttaatggatgtcactttacacccactaggatggctagaattaaaagacagataatcacaagtgttggcaaggatgtagagaaattggaaccctcatacactgctggtgggaatgtgaaatggtacagccactgtggaaaacactttggcagttcctcacaaagttaaacagagttatcacatgacctagcaattacactcctagagacagacaattgaaaacatatgtccacacaaaaatttgcacacaaatgttcacagtggcattattcacaatagccaaaaagtggaaacaactcaaatacccatcaactcaggaatggacaaacaaaatgtgatatatccatacaactgaacactatttggtaataaaaaggaatgaagcactgatacatgttacaatactaatgggccttgagaacattatactaagtgaaggaagacagtcaaaaagaccacatattgtatgatttcattcataccaaatgtctagaaatgtcaaatccatagacagaaagtagagtagaggctgcatatggttgggagggttggtgggaaatggggagtgactgttaatgggtacagggtttcttactggggtgatgaaaatgttctaaaattaactgtggtgctagctgcacaactgtgaatatactaaaaccactgaattgcacacttcaaatgagtaaattgtatgctatatgaattgtatctcaataatgccattaagaaaataataaggccaggtgcggtggcttatgcctgtaatcccagcactttgggaggcagaggcaggtgcattgcaaagtcaggagttcgagaccagcctgaccaacatggtgaaaccccgtctctactaaaaatataaaaattagctgggcgtggtagcatgtgcctgtaatctcagctactcaggaggctgaggcaggagaatagcttgaacctgggaggtggaggctgcagtgagccgagattgcaccactgcattccagcctgggagacagagtgagacaccatctcaaaaaaaaaaaaaaaaagaaaagaaagaaagaaagaaagaaagaaagaaaaaataatcagctggtaggatttaagcttgggagtgatgtggagaaaaagtaccaaagaaagaacctaacaaagatagcaaagctgtacgattctggagtagagaaagggagagtaggtaaacattcgaccggtcctgatgataccatttaaatacctgaagctaaccatgcctgaagcaaattatccacaacagcttttcagttaagagagaaaataattattcatttttggtttaatctactttgagctaggtttctggcaactgtgtttaaaactactaataaattcatcaatggattaccccatttttcaaaccagggtcaacagacctctcaggaaaatagatatattccaggttgtgcaagagagctctataacaatataattctctttttgttttgctatttaacttttgctatctaaaaaaattaacataagcctgctctggggattctctgggtgaccaaccttatatacataaatgacgcatttgcactaaatgaagggcaatgaccatatggttagctatagaaatgaaggtactgaaagggttcaaataaaaaaccttgctattatttatatataagtagggaatatattatatatatagtatatatcagtaggtatgaaaaactcaatagaagtaggtaggcagtgactcagcaaaatactcattcaatatatgaaagctgattcaaatggcaatggttttgtagtttcacttgactgctttgttttatggttgtgtaagaactctgagaatgtttcaaacattttaagttcaggggtgtctgtgaaatgtttttcttataacaagaattggtatagtacgcaaatccaagaaaactggattatatcttggttccttagacaatttgactggcatctcaacgattcaaactttcaaagtaggttttgggaacaaattacatacaattcagaaagaaaatagaggctcttcatattttctttgtccaagtttttatactatgcaaattatctttttttctgaaagcctgaacacatgaagtccaggtacattttgagaagacatttaataactttattattttatccttattcattttcaacttttgtctctgttaattttcatacttcatctatttgtagaaaatagctggtttacactaagatttaaaactcactagcataatactttgcaaagtttgcctatattttaaaacattttatgtcagctttgggatggggcactataataaaatatacttctacaaagaagttttactttatactcagggtatagactttataggcatacgcttttattataattcatatgtaaaagatataatatggggaaaagactaatgtacaattactggccttttgaagccaatctgtatagtaaatattttatgtaagtttcataagatattctataatcactaattcctaaagtaacctcaagaagtatgtattattaatcaatttgctttttatacgagtaaaacttatccaccagggaaaatgtaagtaagtgcattgatgggaacactggacataggggctgacaacctgagtgggaatttctggtctaccacttcctggctgccaaatctgtaagtataatcaacctctgtaagccttagtttttctatctgtaaaacgaaaacagtaataccttccttgcagcactactgtgaacattaaataaagcaagtgaaatattcctcaacagtactttgcactatttttctcaacttctccttccttacctgaagtcataccgttaagttgatgaatacaagcacttaaagaaaacaaatctagttcacatgaagagctcaattaaaatcatatcataaataaactgcatcacatcagtagttctcaaactcttttatcccaggatttcttttcacttaaaacttaatgagaaccccaatgagctttatgtttatatggacaatatgtgttgatatttcccatattagaaattgaaactgagacagatttcaaatgtttttatttaaaatatttataagcccattacaagttaataaaaatacttttaatgagaataacttttaaaaaacaaatttaatgagaaaagtaatattgatttacatttttgcaaatgtctttaatatttatcttaataaaaagcagctggattctcttattctctggggaaaaatgctgtatgatctcacatgtggaatctaaacaactttatctcatagaaacagagagtagaaagatggttaccagagacttgggagttcaggggtgggacagatggggaaaagatgttgatccaagagtacgaagtttaattagatgggaggaataagttttagttatctattgcactacaaggtgaccacagctaatactaataatgtattgtatatttcaaaattgctaaaataatttctaacattctcataacaaaatgataaattggtaaggtgatggctatgttagcctctttcaataatgtatacatatcaaaacatcacattgtaccccataaatacgcacaattatcatttgccaataaaaagttaaaaaggaaacaaaaaaatgaaaaaaaaaactccttaaaagaaaactactttgcagcaaatgaataaagtctagacgaatactctactttcaggagtcatttctacagttcattactagtgatgtttctctgaatgtacagagcactgggaaaaaaagtctagacgtatatatttgattcaaattactgaggaaggctgggcatggaggctcactcctgtaatcccagcactttgggaggccgaggtgggtggatcacgaggtcaggcgttccagaccagcctggccaacatagtgaaaccccatctctactaaaattacaaaaattagccgggcgtggtggcaagggcctgtaaccccagctgcttaggaggctgaggtagcagaatcggttgaacccgggaggcagaggttgcagtgagctgagatcgcgccactgcactccagcccgggcgacattgcgagactccgtctcaaaaaaaaaaaaaaaaaattactgaggaaatcaaatctttttgaatcactacttaagacaaactcactgaaaaccaagtagctgagatttggagttattcaacctaagaactttttcaataggatattcttcaactcttcaacatgcttagaaataatattaaagtatgaaaaagtcgaaaaaaaatgaagccttaaaaataaaaatataaaggaaaaaggaattgaataatacttcttaaaacttttaagtgagcctccttgcttattctccgtgaccacctcactctcacaaaaagtgagacataatataccaaattgaacattggatgagggtcagaaagcctaggtttaagaattggttccatcacttcctaggcacatgacctcggtaaagttctgtccttgaggctgtttcctcatcttcaaacagttctaacgacaccctacagcccatctcaaaaggggtgctaccaatgaaatatacaaatgcaagatacgattataatggaatctgtactgctgtagaaacatcaaaggtacacagccctaattttacaagcaaatcagtgcctttgtaggctcagtgaagtttctgcgtaaggagattaagtttgcacagtaacccccaaaccaggacacctcacaaatactaagaggagacttttgcagtttaaaactctacttctaggtttctattttatgtttaggggcactaaaagacattacaactcatagtccaaacctgaaaacaatagtaaaaaaaatttaaggtcgcagatttaaaaaactccacaaaactaacaaatctttccaaacaaagagaatcccctggatgaaggtctcccgtgcttgcagaagctggttcacttgacaatttcctctcgaatttctccttaaaaaagcattaaaacctgagagaagttgaaaggaactccctccatctctagagcaggagtatacctcagcataattttttccatctctttaagtaaaacctgcaaacctcctagttagaatatagtgtatttaactccacgtttctcctcagggctcttatcctctagacaataacggaatagagcacgatttctgtgacagagaagggaagtccctttggccagaacaaggttgtgggcatggaatgaccggtcctgtgtggggggaacctgcgcagaaagaaggggtcacagggtctctgatgcctgaaagttcggaatcccctcaagtctcttttcgtttgattgaagagacttgagggtgggcgggtctccgtcaaacatcagtatcaaccgtacaaaagacgaaagggagttgcctccagaatgaaaagcccaaaccgggttggaaacagaccgacaggactcaggaggtgagaaggctgccgcagctgccgcggcccgcgaaaccactgcccgccgcgggccgccaggctctacctccagaaaaccctcccccttcagggcccggcgcaagatggtggcccaccagctaccacgccgccaagcctgtcccctcccccgcacccccgtcgatccgcaccggcatagagaccctcagccagccgccctcagaaccgccctctggggaaggctgcctcggccgcgcgggagagctgctgcctccttccgcgcggcacaggcgggggcgggggccgcttaccgagagcagagcagatcggtctgactggggttcggataaggaggaggagaaagaggaggaggaaagggaggagcgcgaaaaacctcaggcgacagcctcagcaacagcgactcccccggagacttccagcgcggaaccggcgtctcagccgggggcagaagtatataactgcacgcgctgcctcatgggtagacgccgactccaccccctgaacatccggggccttttaaccgcccacggacggacggctggtacttacatgtgcacatgtgcagctactttacttaccgtcgaaggcagcggaggaagtgtaattgactagcgtggatgcagcttttctaagcaaacgctcgatttaacctggagttgtcatcccaaaaaatacattgtacctgactacagagaaacatgaattctgggtcttccttgtgtgtgagggctaaagacacgagttaaaaatataaatatattgttttctggaaatactgtacttgaaacacgtgtcaaaatactagttatttttaccttttgttttaaacatatggttttgcttgtctctctgttacttctaattgccatatggatgcctatagtaggtacaaaaaatgctaaggaaaaatacatttactcttacacacaaggaagacccagaattcatgtttctctgtagtcaggtacaatgtattttgtgggatgacaactccaggttaaatcgagcgtttgcttagaaaagctgcatccacgctagtcaattacacttcctccgctgccttcgacggtaagtaaagtagctgcacttgtgcacatgtaagtaccagccgtccgtccgtgggctggccgcggtggctcacacttctaattccagcactttgggaggctgaggtgggtggatcacctggggtgaggagtttgagaccacttccctttcctcctcgcctttctcctcctccttctctgaaccccagtcagcctgaccaacatagtgaaaccccatctttactaaaaatacaaaattagcagggtgtggtggcacatgcctgtaatcccagctacttgggaggctgaggcgggagaatcactggaacttgtaaatacatttacaagaaaaacacttgccaaaatactgcttacagaaacattttctagacattgtgctttgaactgtaaaagtttcttctcccaaatttctccacaaggtttatagcagtactggttcatctctctttttcttttttgagacggagtttcgctcttgttgcccaggcaggagtccaatggcgtgatcttggctcaccgcaacctccgcttcccgggttcaagtgactctcctgcctcagcctcccgagtagctgggattacaggcatgcgccaccacacccgactaattttgtatttttagtagagacggggtttctccatgttggtcaggctggtctcgaactccccacctcaggtgatctgcctgcctcggcctcccaaagtgctgggattacaagcgtgagccaccacgcctggcccaattcatctcttaagagttgcccagactgaaaatatcgtgtggcttacataacacacacgtaaatcctgtcactgaatcctaccattttttttatttgagctagttttttctttcttatttatacagctatttgcttctgaccctgaaaataagctttacaggaaaagacagagaataatcaaaataaaacagtgaaaagtcccaaaatcttggagcatgcatagttggtccctgcttccggtcagggtgataagaaagtccgggcaccttttcctttgatgccagcaggaaatttaaaactagcaaatctacagccgcatgactctgcttttggctgtagtgggaaatttaaaacttgtgattctccagcctgcctccttctttggcattggtgggaaatttaaaactggcaacaaaaattggtgcagttgagaaatttaaaacttgcaaatctacagcctgtgcggcattttcaccagccccacttcctagatgctataaaggcccatccaacttcctctgcctctgaaaccagcccagacctgtttgcagcacccagccctccctcacttacccccactagtccccagggtaataaaatttctctcaaattctcttgtcatatctagtgtcacgagtgtccacatccaacctaaaattacgaggaggaatggtcaaactgcctcagcaggatgaccagaaaacacttatacacccaaatttcaatctaacttattctttttttcgtgaaaaatacagccaagaagaccagcgggctctggtcagttgactgtttgcagactctggtcagcaaattttctatcaagatgaaaatttgagaaactaaataataacaataattaaaaggatgtctggtgagaatggaattaacacatgggaaattgtttgggtgatttttaactgttcttaaaactcttccccaggcttctagaaaaccactctatattggttctcttgactggctggccgtacgttcttttttatttttcagcacttccagtaaatgagggcttactcctgtataggtttttctgacaattttaaaaattgagacaaatttacatgaaaaaaatctaccattttgaagtgtacaatagagtgatttcttatatatatttacagtattgtgcaaccatcactgctatctaattccagaacattttcattacctcccaccaaaaaacctgcaaacctattagtagccactcctaatttcctcctatttgtatcctctcaccaatcattaattaacgttttttatctatggatttgcctattctggatatcacatataaatgtaatcatacagtatgtagtttttcatgtctagcttctttcattcactataatgtttctgaagtaggttcatccatgttgtagcacatatcaattcgttcttttctctctttctccctccctccctccctccctccctccctccctccctcccttccttccttccttccttccttccttcctttccagatggcctctggctctggctcttaggctggagtgcagtggggcgatttccagtcacggcaacctccacctcccaggttcaagcaattctcctgcctcagcctcctgagttgctgagattacagggtcctgcaaccatgccaagctaatttttgtatttttagtagagttggggcttcatcatgttggccaggctggtcttgaactcctgacctcaagtgatccacccgcctcaaccttccaaaatgttgggattacaggcttgagccactgcacccgggccacttcatttctttctattattgcatgatatttcattgtacaaacatatcactttctgtttatccattcttcagttgatggacgtttgggttgtttctgcttttgggctgttataaataatgtagccatgaatatcagtgtattagtctgttctcacactgctcttaagatattacctgagattgggtgatttatacacaaaggagatttaattgactcacagttccgcatggctgggaaagcctcatgaaacttataccatgaaggaagagaaagcaggcaccctctttacaaggtggcaggagagagaaagagtgtgtgtaggaggaaatgtcaaacacttataaaaccatcagatcttgtgagaactcactcattatcatgagaacagcatgggagaaactgcccctatgatctaatcacctcccaccaggtctctccctcaaaacctggggattacaattcaagatgagatttgggtggggacacgaagtctaaccatatcaactggtgtacaagaatttttttttttttttgagatggagtttcactcttcttgcccaggctggagtgcagtggcatgatcttggctgactgcaacctctgcctcctgagttcaagcgattctcctgcctcagcctcctgagtagctgggattacaggcacccaccaccatgctcggctaattttttgtatttttagtagagacggggtttcaacatgttggccaggctggtctcgaactcctgacatcaggtgatccacctgcctaggcctcccaaagtgcagggattacagacatgagccaccatgcccagccggtgtacaagatttttaaaaaagctttatgaagataaagttcacataaggtacaatttatgcacttaagtgtgcaattcagtggtttttagtatattcacaggtacatgcaaccatcaccacagtcaattttagaacactttcatcaccctaaaaagaaattctggccaggcgcggtggctcacacctgtaatcccagcactttgggaggccaaggcgggcggatcacgaggtcaggagatcgagaccatcctggctaacacagtgaaaccctgtctctactaaaaatacaaaaaattagccgggtttggtggcgggtgcctgtagtcccagctactcgggaggctgaggcaggagaatggtgtgaacctgggaggtggagcttgcagtgagccgagatcatgccactgcactccagcctgggcgacagaccaagactccatctcaaaacaaagaaaaaaaaaagaaattctatgcacattcgtcacaacatccttactcaccctacccctcttttcagctaccctcctgccctacacaactactagtctaccttttgtctgtgcagatttccctgttctttatatttcatataaatggaagtatataatatgctgtcttttgtgactggcttctttcccttagcataatgttttcaaggttcactcacgttgtagcatgtgcttatttcctttttatggctgaataatattccattgcatggctatagtatattttgtttattcatttgtcagttgatgaacatttgtgttgtttccacttttgggctattatgaatattcctgtgcaaatatttgggtgaaaatatattttcaattctctttgttatataactaggagtgtaattgctaagcaatatgataactataattaactttttgatggactgttaaactttttcaccatggctgcacagtttttcattcccactaggatttattatgattccaatttctccacaaactcaccaacacttgctattttccatttttgtttttcttattttggttatagccatcctaatgagtgtaaagtagtaccatggtttctgctggcttctgatctcagaatttctgccacttcctacagtcagtccactggtcccgggttttaccctttgatctgctgtggtgggcccacttgttctccattcaacatccgtgttacacaggaactgggaacaagtcagggaaactaaacctcagatctgccatctgcctgagcctgaggcattttcatttttattttgatatcactgtgctttaggatggtacacagaagcccaataaacagcctctttctagagcaagatggcatgggtgaggagttggaggaggtaaaggaagagaggggttggagaggacggaggagaggacgggggatgaggatgagaagggatagaaggaaggagaagagataagaaaggatggagaggaagggagaattatccatgacctgaaaaagttgaaccccttcctctagttacatttccagtttctttcctggcctgaatttgggtggagcctgatgcccaaggcaggtgttttgtgtacatctagcagctataatgttaccaagcacagagaagtttgaagcaagtcacataggaatatttattgggcttcccaggcagcatcatgaagtgggctgacagattgtgttttcaatttactctacgtattattattaaaaagtccttaagattgttgttttgttttcctttttctcagtatgagtatggatcctcagtggcttttggtcaactcattctccttctgaatatggagacagtttggaagcaaatacacgaagtgctgaacccctagtcatatgccctcaaaagtgacattggcaaaatgttaaaactaactcttgttatctttcttttaaatatcttggtcaggcgtggtggctcatgcctgtaatcccagcagtttgggagggcaaggtgggaggaccctgaagtcaggagttttgagaccagcctggccaacatggtgaaaccctgtctctattaaaaatacaaaaattagctgggcatgatggtgggtgcctgtaatctcagctacttgggaggctgaggcaggagaatcactcgaactgggaggtggaggttgcagtgagctgaaatggcaccactgcattccagcctgggtgacagagtgagactccatctcaaataaataaataaataaatatcccttcccatctggcatccaagagcacatatcacttccccacattctgcctatccacgtaaactccaagtcccctaaactctcgttggctggaatctaaaagtctaaaagtgctagagtttccccctactcacgttagaagagctgactatagatatctcttcttgacttgttcagttatgtcacgttggtaggttgaaacttgccatgatgaaagtattaacaccacaggaaatcaacaaacactactaatgagagctggattaccagcataaacccctggttgaattctatggcttcagtctctatggcctaatgcttaagtaaaggtgcctcagaaagctcctcatattcttttaaaccaaagcagcaattccatgtttacattttgagcttctacctaatatttttttgaagaaaagtttccactgatatgaaataaatgataaacatttgaaagctattgttctaggccaagccaccagttttgaagatgtgttcatggaaacctagaaaggttaaaatagttattcaacatcacacaagggacaagagaaaaaagtcagggcaagtactgggacctaggtttccttaatcccagtccagtgctcttcccatctgtacttaataatactgcattaaaatgtttcctgttctgtttctcatcccatcaaaaatgggtttgtcaaatagtctgtctaataaaataatcaacgttcccaggaacgtatgtttattatgagtggggccttctagagaaaatgccccctcagaacactttagtgaatggaagatattcactttagtgaatgaaaggaaagaaaataggcaggagtagagataccagatatacacaaatgacaaaaattgtggataaaaattatacagcacttattgtgtgcaaagcactgttctcagtactttataaatatgaattatttcatacaacaactctatcagtaaagtactcttattaccatcccactttacagatggcacagagatatcaaataaattgttgtcacaaaactggaaagtggtaaaactaggattttaacccaggcattctggttctagcatctggcatcttagccattatgctatcctgtctctttaggtgatcaataaatatatgtctctttaggtgatcaaataaatataaatatatagctgatcaaaaaatatatatatataattatactatcctgtctctttaggtgatcaataaataaagatagtgaatgaatgaataagcatataaatagcatgagacaccaagatcggaggttttggggtgtgttttaaataacagagggaatatcacaccatgctgtcttcatgtagaaccaaatataagtgaaatagagtaagtagccagtagaatgtatctcccaggaagaaaaagtcactcctatcaaaggtttggtggaagagatatgcttaatcacctgggtctctaagatttcaattaatgcctttctatgcctctcacatttctgattaagccacttagtggtagaggactcttgagctagtcccaaggatgatcaggccacttatataatttctaggaaaagagagttttcacactcctctggtaactgtatacatagattgacttagcctttcaaagcgaaaggtttaaatgtatgtaatcaggactttgcattatgctatatgtcagaggaaaggcacaagtaagtatgcaacatagatgcttctcttatggcattaacatctgttggcaggttaggcccaaaaccccagaaatgatgagtgagcaatgcaagaacatgtataatcaactattaactttgtgtggttcagactgtcaagtacagaaaaaattcacagaaatggaaaattacagcagatggaagtagacatggaaggcttgctcttaagcttgagtttagaccaagcaggatcttgaaggttgaatacaatttaataaggcaaagaagaggcatttcaggtaagaacagtgacaggagaaaaggtaaggagacagaattgaaaagaatgcttctgtgagacaataatgggaccagtctgattagaggaaatgttgtgtatgagcaaggcaggagaatggggtctggaggcagggaacctaaggccgtttcctgctgacttcctagaaataaattgaaaggaaaaccctaactttccacgcctaagtaacaagaggactagaggatactccctttgcaaaccttttctgtgcagcagatggaacattgaaagcacctctgattggttgctttttctcaggcctctgagcccaagcctgcatgtatacatccagatggcctgaagtaactaaagaatcacaaaagaagtgaaaatggccagttcctgccttaactgatgatattaccttgtgaaattccttctggctcagaagctcccccactgagcaccttgtgacccccgcccctgcctgctagagaacaacctcctttgactgtaattttccgctacctgtccaaatcctgtaaaactgccccacccctaactcccttttactgactctcttttcggactcagcctgcctgcacccaggtgattaaaaagctttattgctcacacaaagccttttggtggtctcttcacatggacgcgcatgacatttggtgccatgacttggattgggggacctcccttgggagatcaatcccctgtcctcctgctctttgctccgtgacaaagatctgcctacgatcttgggtcctcagaccaaccagcccaaagaacatctcaccaattttaaattgggtaagtggcctctttttactctcttctccaacctctctcactatccctctacctctttcttctttcaatcttggcaccacccttcagtctctcccttctcttaatttcagttcctttccttttctggtagagacagaggagatgctttttatccatgaacccaaaactccggcgccagccacagactcgggaagacaggcttcccttggtgtttaatcactgtggggatgcctgcctgattattcacccatgtttcagaggtgtctgatcaccgtggggacacctgccttgatccttcaccttagtggcaagtaccactttcctagggggcaagtacccccccaccccttctctccatgtctctaccctctcttttctctgggcttgtctccttcactataggcaactttccaccctccattcctccttcttctcccttagcctgtgttctcaagaacttaaaacttcttcaactcacacctgacctaaaacctaaatgccttattttcttctgcaatgccactcgaccccaatacaaactcgacaatggttccaaatagccagaaaacagcacttttgatttctccatcctacaagatctagataattcttgttgtaaaatgggcaaatggtctaaggtgcctgacgtccaggcattcttttacacattagcccctccctagtctctgtttccaaagcaattcatcccaaatctttcttctttccctcccgcctgttccctcagtaccaaccccaagcatcgctgagtcttttcaatcttccttttctactgacccatctgacctctcccctcctccccaggctgctcctcaccaggccgagccaggtctcaattcttcctcagcctccactcctccaccctataatcctctatcacctcccctcctcacacctggtctggcttatagtttcattctgcaactagccctccccgacctgcccaacaatttcctcttaaagaggtggctggagctaaaggcatagtcaaggttaatgctcctttttctttatctaacctctcccaaatcagttagcatttaggctttttcatcaaatataaaaacccagcccagttcatggctagtttggcagcaaccctgagacgctttatagccctagaccctgaaaggtcagaaggctgtcttattctcaatatgcgttttattacccaatccgctcttgacattagaaaaagccccaaaaattagattccagccctcaaaccccacaaacaagacttaattaacctcgccttcaaggtgtaccataatagaaaagagttacaattacttgcctctgctgtgagacaaaacccagccacatctccagcacacaagaacttcagaacgcctaagcaacagtgaccaggcattcctccaggacctcctccatcaggatcttgcttcaagtgccagaaatctggccactgggccaaggaatgcctgcagcccaggattcctcctaagccatgtcccatctgtgtgggaccccactggaaatcggactgtccaactcaccaatcaagcaagtaattacactgaacccccttgggcgctctctaattggatgtcctgggtcctcccaattcctagtcctttaatacctgtctttctccttctcttattcggaccttgtgtcttctgtttagtttctcaattcatacaaaactgtatccaggccaccaccaatcattctatatgacaaatgtttcttctaacaacctcacaatatcaccccttaccacaaaatcttccttcagcttaatgtctcccactctaggtacccacactgcccctaatcttgcttgaagaagccctgagaaacatcgcccattatctctccataccacccccacaaatttttgccaccccaacactttaccactatttctttttatttttcttattaatataagaagacaggaatgtcaggcctctgagcccaagcctgcacatatacatccagatggcctgaagtaactgaagaatcacaaaagaagtgaaaatggccagtcctgcattaactgatgatattaccttgtgaaattccttctcctggctcagaagcacccccactgagcaccttatgacccccgcccctgcccgccagagaacaaccccctttgactgtaattttccactacctacccaaatcctataaaactgccccacccctaactccctttgctgactctctttttggactcagcctgcctgcacccaggtgattaaaaagttttattgcccacacaaagcctattggtggtcttttcacacggacacgcatgacactttctgtaaccaatcagacgtttgcacaggagtgtgatctttgtaatttcacttcagcctctgattgtgggccaccactcatttatgaggtaccaagtggccaatgggaaacctctagcgggtatttggacctgagaagattctgtatctggggcccttgagccactgctcaggcccgctcccacactgtggagtgtactttcattttcaataaatctctgcttttgttctgtagttgcttcattctttccttcctttgctgtgcattttgtctaattctttgttcaaaacgccaagaaccctggacaacctgcagtcaagaccctctaccagtaacatattttggcaagctggccaggagaaagcaggtccaaagtttgggatttatttttctcctttccccttttacatacagggaaatctttctgtctctctcttttcctttctaactcaggaccctcagtaggcagcacctaagaatgcagacaactgcaactttctggccaggtccactctctggtgaaactgaaagtcttccatgtggaagtgcctgaccaccaccgcctggtttgggtaagggacctgagtccttttccttgttttcgtttttctgagtcctattcctttcttcctttttctgagttttcttttttcatttttcagtctttcagcggccttttcctagtagctccttggtaattgaggggaactggttgggtccactctccgttgttgtctgaaggccaaggagaaagcagggatggctgcccttctcagaagggggaaagactcttttctatccttttcagtgatagtccctgatccctatgtgtgaagcaattggcagtggcagttcatccagggtgaactcacacatgtttcaggcgacttaaacctccttttcttatgctaaattcttcccttcccccactcgactggctaaggacagaaaacccacctagctatgccaaaaaaaaaaaaaaaagggttatactagtcagagggtctgggattgtcccaggtagtctgtggggggtggggaggttaattcatgaaagggaatttattattgcctcaattgagagttaaagggttgctttcagtgggatagaaaatccttaaggaaagaaagttcacaataggtcctcagtggtagagggaaccattccaaagtggtgctgccatacatctaaggtcagatatctgacaggctaagtcagggcctttaaggagggacgccctcagggaacccagcctgggcccagaatttttccaaggggacacccgggcaaaatttgggtcacctagtgagccctccacttttcaaagtcctcttttccagaccactaagggcaactgtcagtctattccacctgattccactgtgggcaactctccacatattccacctgattccctgcttggttacatcatctaccatcggaatctatttgacaatctaaagagaaaatgtatacttttttctgcaatactgtctagccccattataagctgcccagcccagaacaatgggcagtcaatggtagcttaattatgacattatcctgcaattagacctattttgcaaggggtagggcaaatggtcagaaatcccatatgtaaaggctttcatgaccctattccacacctaaccatctgtgaaactcccagaacccactcccataaaggaaagttctaaggcagaactagatactatagatgacccccttttacaagggccacttgtctgtcagggtgaacagtgaccacccccatatggccccttgccaagtgctcctgaggctaaaacccaggagcaaacaccggagaccctactaagtccccctcacactcagagaggaacaccgtatttaactctcaaccctgctaccttttagggaattagcaggagctaaggggtcagtcctagtgcaggtccccttctctataattgatatacaataatataaggaaaagctgggaagctattccgagaatcctaggaaatttgcagatgggttccaaactttgaccttagcctttgatctctcatggagagatgttcaattcattctagcaacctgttgcactccttcagaaaaggaaggagtcattgaggccacccaccaggaagcagacgaattatttgcccaaaaccctcagggcaattgctcaggcccagacacagtttccattactgatcctaactgggaatataacacccctgtgggaatgaacaaccgggttaaatttcttgaggctttcctttgaggaatgagaaagggaataactaagacagtaaattatgataaagtaagggagattatgcaaggcagggaggaaaacccagccatgttttgtggcaggctggaggaagcctttaaaaagtacactaatctggacccttccttttccaaaggcaaaatattaatggcacagcatttcattagccaatctgccccagacattagacataagctccgaaagctacaaatggggccacaaactaatcaaaatcagcttcctgataccacctttatggtgtataacaattgtgacctggaggaaggaaaaaagggaacagaatgaagaaaaatggcaagccagaattacggcagccatcattggcgatgccttgaatgctcaaagagcatctaagggaaatccaaagggcaataaggataatgccagcaaaggctcttgcttcaaatgcaagaaaaatgggcactgggcaaaggaatgtagtaagcccctgccaggcccctactgtcaatgcgaaggcaccagttgtggcccctggcactagagaattgactgtcccttctcccaccaagggtctcagtcaggcaaaactctagttttgcgaaaggaggaattagatgaagactgaaggggcctggattcttcctcactgcccctgcccaggaacattttaattactactgaggagcctcaggtaactctggacatcacaggcacccaaattcagtttcttttcgatacaggggcaaattactctgttcttactgcttatgcaggaaaactttcctcccagtccatgagtgttatgggaatgaaagggaagccacagacaagattttttattcctcctttgatttttcaatttgagagacaaatcttccagcaggaattcctagtagtaccaagctgcccaatccccctcttgggaagagatattgtggttagaacaagggcactacaataatttaagcatcacccagtgaaattgctaatagtcaaaattacagacaatgtcacagaccacattaataaacaggctaacccactggcatggtatactggaaaaccggggaaggctaaaatggcagtgccagtcaaaatacaacctaaaaatcccagctaattttccaattgaaaacaatacccaattaagcaggaaacaagaaaaagccttacaccaatagttaaagtattacttacccatgggctcttaagaccctgtaattcattgggcatggtggctcacacctgtaatcccagcactttgggaggccgaggtgggcatatcacttgaggtcagtagtttgagaccagcctgaccaacatggagaaaccccgtctctactaaaagtacaaaattagctggacatggtggcacatgcctgtaatcccagctactcgggaggccgaggcaggagaattgcttgaacctgggaggcagaggttgtggtgagccgagatcacgccattgcactccagcctgggcaacaagagtgaaactctgtctaaaaaaaaaaaaccctgtaatcctccctgcaatacccccaccttacccattctaaaaccttcaggggaataccgattagtacaggacctcagaataattaatgaagctgttatttccatatactctcctggcttaggtgccaggggatgcaaaatggttctcagtcctagacctaaaagatgctttcttctccattcccctggccccaaagtcccaatacctttttgccttctaatgggaaaatcctaataccagggaaaaacaacaatacacttggacagtgctccctcagagcttttggaatagcccccatttctttgcctgggctttagagaggggtctgaggtatctgcaattagagaatgggagtatacttcagcgtgtgaatgaacttcttgtgtgtagcccaactcaggagtttctgaccaaaatactataaaaactttgattttcctggcagacaggagatataaagtgtccaaaaagaaggcacagattaccctttaataggtccaatatttagggtatgtcttaacacttggagcctgacaaatagtcccagaatgagtgcaagccatatgtggtttgggggccccccacaccaggcaacagcttcgttctttttggggaatggccaggttttgcagaacatgggtaccaaatttaggactcagagcaaagcccctgtatgaagcaacaagggggcctgaaaatcagctaatggaatggaccccggaaatgagaggagcctttgccaagttaaaacaggctctcgcccaggctcccgctcttggcatcccggacctaactaagcccttctttttgtatgtagcagagaagagggacatagctgtgggagtgctagcgcagaaatttggatcagaacacagaccaaccacctacttttcgaagaagttaaacggagtggccttgaggtggccaagttgcctgcaggcagtaacagccactgctatgttagtggatgaagccactaaaattcccctgggccaaccactggaagttctagcccctcatcaggtaaagttagttttagagctaaagggacacctctggatgacaggggaaaggataaccaaataccaggctatgctcctagacaatccagatgtaatccttaaaacctttaacactgaatctggcttcattgctgcccataggcccaataactgatcattcctatgagcaggtcattgcacgtatgttagctgtcctgctttgaaagatcagcctctcccagattctgaggatgaccgattcacagatggcagtagttttgtgtcaaatggggagtgctgagctggatatgcagtagtgaatcataacataattactgaagcccagccactgcccccaggcacatcagcacaaaagactgaaatcattgctcttactcgagcattaatgttgggacaagggaaaaagcttaacatctatacagattttaaatatgcattctttgtggttcatgctcatgctacaatctggaaagaaaggggattactaactagcaaacactcccccataaagcatgggcctgaaattcttcagctactggaagcaatacacctgtcaaaggccatagctataatccattacaggggacatcaaagggactcaacccctatagcacaagggaacagaaagcctgatagagaagccaaagctacagccctcagggtgcaatcccaacagatcctagcactacttcctttctatgattccccaatataaccggagtacacactacaggaagaacagttaataaaggaagaagggagacaaaaacaaggatcctggtggtattggggtcaaaaatatatctccctcagacagctcagtggaaagttataaaagccctgcgtgtctctttccatgtggggagagatgcaactctgcccatggtaaataagctctttactggatctaacttggcttcagtggctaagcaggtctgccaagcctgctcactgtgtgaacttaacaacccaggaaacaaaatgcctcctccaatagaaccagtccagaagagaggaacttatccaggggaagactggcaattagacttcacccatatgccagcttgaagaagatacaagtttttgttagtgctaatggatacctttactggttgggtcgaagcttatcctaccataacagagaaggctaatgaggccataaagtttctcttaaaagaaataatcccctggtctgggttacctcagagcctccaaagtgataatggctcatcccttatctcccaaacaactcaaggggttgctaaggctcttggaatcaaatactatttacattcagcatggaggcctcaatcctccaggaaagtagaaagggctaaccaaactctaaaatgagtgtaagctaagctatgtcaggaaacatcagaaacttgggtcagcttactgcccatagccctcttaaggatccataatacccctagagcaaaaattaacataagcccatacgaaatgttatacagaaggccattcttaactaatgatttaattattgatccagaaacagccagtttagtaaaatacctagtcaacctaggacaatttcagcaggctttacaaaagcttggaattcaaaggctttccacactgggaactaatcagtaaccccaaatcaggccaggagataaggtacttgttaaaacatggaaggaaggatcacctgctcaacaattacaacccaaatggaagggaccattttcagtaacactggccatgccttctgtggtcaaagtactaggattagatagttatatatatctttcaaggaccaaaccagcaaaaccagaggccccggaccaggaacctgaagttcccatcagccactacacctgtgaacctgtggaagatctgaagtacctgtttagaagacagccgaaatgcctaccaactttccttggtgtctttgttgcatagttactgtagactggataatagtagccatttatttttaactattgcagtttaattgccttcttccaaatggatggaatcactacctttgtagtaattaagcagaatgtttttaatacaattctgcaacaaacattcctgacagcataggtatccacccccaaagttcccattaaatcttttaaccaaattcatttcctctcacatagaggccatcaaagttcagatgcttgtgtgacaaggtttccagacagttccaggtgaagacaccacccccagccatcaagaagccacccggtctccactagacagagtagggcaaaagttccgtgatctccaacagatagggactatgccccaagtcagcaggaagcagttacagaagaaagaccgtcaggccctctgcctcctctagagatttatggggatcacatctttcggggggagatgaggcagaataggttctggaggcagggaacctgaggccatttcccactgacttcctagtaataaattgaaaggaaaactctaactttccatgcctaagtaacgaaaggaccagaggctactccctttgcaaacccctaccttttctgctcagcagacggaaaattgaaagcactttctgcaaccaatcagacgtttgcacaggagtgtgacctttgtaacttcacttcagcctctgatcgcaggccaccacttcatttacgaggtgagcaccaagtggccaatgggaaacctctagagggtatttggacctgagaagattgtgtatctggggcccttgagccgatgctcggcccactcccacactgtggagtatactttcattttcaataaatctctgctttcattctttcattgcttcattctttccttcctttgctgtgctttttgtccaattctttgttcaaaacgacaagaacctggacaacttgcagtcaagaccctccactggtaacacaagtgttatgggaaatgagtttaaatacttattcatttattcatgtacataatcatccatgaagcaaatgtttattgagcaccatgtcacatgttgggaatactgagataaatgggacacagtctctgccttcaaattggttacattcaagtggtgaaaacaggttcacaaacataaaagtactatgataaaagtaagctacaggtggcctcctgcctcagcctggactgagtcatatttcatttaaatgctgtgatttcacttctgctacatctaccttcttggactcatatttcaggacctgcattatgaattggtttctttcaggataaattagacaccaaaggtccatgataccatctgaagaagaaccttaattggtagaacatacaaaagcagttttttgttttgtttcttttttttttttttttgagatggagtcatgctctgtcacccaggctggagtgcaattgcgcgatcttggctcactgcaacctctgcctcccgggttcaaatgattctcctgcctcagcctcccaaatagctgggactacaggtgtgtgccaccacacccggctaatttttgtattttagtagagatggggtttcaccatgttggccaggctggtctccaactcctgacctcaggtgatctgcctgcctcagccccccaaagagctgggattacaggcgtgagccaccacgcctggccacaaaagcagttttgtatttccatatagtgtagcacttttttttgagagtccttcctctttttttttctaagagcaaaaatgggaatattaaacgggtgaattttgaaatgtaaaaaagaaattataaatctattttactatatatcctcaagcaagtatagccaaaggaggaggggtaggtaacagtaaatattttatctcctaacaatgtatctataaaccattctgctgaagaatctgacagattactaactgtgagaaaagaaaggttaacaactctgataatacataaactcagatcagatataggcccaatttttgttgtaatcatccatccataacctgttcagatgacaagccctgttgttaataaagcatactgtactacgagtacattgctctgtgctctgcttatatttgtagaaactgtaattgtctaaaacaatggcctcagtgaaaaaatgtgatatgttattagttgtgtaaagattaaaataatttaaacttataatagtagttgttttggaaggattaagacatgagtgatgctgtatagagttaataactcagcattgggtttttttgtttgtttattttgacaaggagtctcactctgttgcccaggctggagtgcagtggtgccattttggctcactgcagtctctgcctcctgggttcaagtgattctcctgcttcagcctcctgagtagctgggattacaggtgtccgccaccatgcccagctattttttgtatttgtagtagagttggggttttgccatgttggccaggctcgtctctaactcctgacctcaggtgatccacccaccttggcctcccaaagtgttgggattacaggcatgaaccaccgtgcctcgccagcattgttgttaagtttgtttccattctggtccttgtgagagagccataaatttcaagccacatcttgtgggagagacaaagttaccccaacagaatgcaagttccatgaaggcatggaaccatggctcatttaccaatatctaccaaagacatagtgattggaatagagtttaatatttgttgaatgaataaataaatgaatgggagtattcaaaagaaatggaacaagtttcagattcaagccaagtcatttttagagttcctccaggatggggcacagaaaattagagtggaatccaatctccataggattgggactgtcagggagcaggggagaggggatggaagcagaccccagacaagtggctgaggataccacatggtattttgcatcctagagtgggacagagaatccttgtgtacagaatcctggaagtaaacaataaagcatgcttctggtccttgccttcccacccctactactgcctcacctaataggattcgaaagtgttcttgcatctttaaatctggattctcctggaaaaaaggaaagagcatcagatctcttctgattatcactaatggagtgacaagtagaacaggatgcaggtgtggttcagggacctgtgtgaggggctaggacaagaacagggtcaaggatctatgaggtagagagatagagccctaggtcttaaaatgaaagggggattaccactcctcttgagatactaaagaatctgggtgaagatagaccaatttaaaggtgataaagaggggtaggtacagaaacattttgcagttgggggagtatgtacaattatggtttaagaggaggagaaagagggtgaaaagatttgttaggttctaagccacagccatttttccttatttatttctggcaaaatttggtgttgtttggagcctaccctaccacatgctctgggaaagtgatgaggcgtggatttgattagtttcattctccttaggaattagtttaggatagatgtgtgacacaattttgcctaatgggacccaaggaaaattctgctagaggtctctggaaaggacttttcttcctttgttgagagatagagatagagacagaaatagagatagataagagagacagagagagagagagagagagagaatgaatcgtaggtatagaagatagtatcccttttctttgctaggtgctcccatttgtatctgacaccaagcaatgctgaagccatgttacagcgctgacaggaggtaagaggaatattacccacacactgtaggtggcagagcggaaagaaaattcacttgggtccttgatgacatccttggtttactcgattgacctaccatggaaccatctttccccaaacttattttataagataataaataattatttttaaaataaatacttatttaaaaaataagtcatctctggttaggtcttctgttacatcttgcacttgtgttgatgcctccatcttttctagtaaggtaggaagaaagagcatgtgttataaatatgaagtgtgggatttgaaaagttggaaacagatatttcagttttcatcagttttcagctatagccccatcttcctctttcttccccaaccccatccccaccccatctcccgtaagactcagacgagggccaggagacacaggactggactcagagaatctctctcttctgatgacctaatctttgtttttggttcaagctcattgtgtttagctccttcttccttgaagacattctttcccaggaggctctccaatcactggagtaaacagacttctgggatattgcctctcagacatgtctaaactctaagctgtagcttaggatcaagtgggaaaccccaactacagtgctattttgtgcctgtatctagcaatactctgctgcctttgagcatgaatacagaaataataaaaatggctcagactcagcattggaaactgcttcaggcattattgggacctgatttcaatgggcaccagatatcagggaaaccagcccccagtatttcaatgtaggttcttttctattttccctaagtgtcagctggtctgagaaataaagataaagagtacaaagagagaaattttatagctgggcctccaggggtgccatcacatattggtaggacaatgacagcgaccccaagccacaaaaccagcaagtttttattagggatttcaaaaggggaggggtgtacgaatagggagtgggtcacagagatcacatgcttcaaagagcaataaaagatcacaaggcaagggcgaaattagaattactgatgagggtccatgtcccgctgggcatgcattgtcttgataaacatcttaacaggaaacagggttcgagagcagacaaccagtctgactaaaattcaccaggccggagtttcccaatcctggtaagcctgagggcactgcaggagaccagggcgtatttcatcccttatgtcaatcgcataagacagacactcccagagcggccattcatagacctacccatgggaatgcatttcttccccagggttatcaattattaatattccttggtgggaaaagaattcagtgatatttctcctactcacacatccgtttataggctccctgcaagaagaaaaatatggctctattctgcccaaccctgcaggcagtcagaccttatggttatctttccttgttccctaaaaatcgctgttactctgttctttttcagggtgccctgatttcatgttgttcaaacacccatgttttacaatcagatttcatattgttcgaacacacatgttttacaaacaatttgtacagttaatgcaatcatcacagggtcctgaggtgacgtacatcctcagcttacaaagatgacgggattaagagattaaagacaggcataggaagttataagagtattgactggggaagtgataaatgtccatgaaatcttcacaatttatgttcagagactgcactaaagacaggtgtaagaaattataaaagtattaattttgggaactaataactgtccatgaaatcttcacaatttatgttcttctgccacggcttcagccagtccctctgttgggggtccctgatttcccgcaacaagacataggagaaggtcagattatgctgcagtgtgcgtgactccagtagactacaactcccataaaagccacgtagcatacagcacagaatgcagcatatacagagttagttctcaacaaatgtgtactgagtttagttgaaatgattggtttctggaatgaaggtcaaatggcttccttttactgaatcttccattcagagagtgcatttcatcttctatccctttaactcccaaaacaaaacctttagtattttcacctcagttgtttaagtttctttttacaacatacttgtgacgtagggagtggtgagaatagttttatttaatttactaggaagaaagaaagacaaagagatgatctgatttagcataagtaccagagggtgtctgtggcagagctgggatggcccattaaatctctcgagccattgttctgatgtccgtgtgtagtggttttgatagcactttcttctttctgtcttactaggctgctaattatgcatgccaattatattcaggaacaccatgggcctaagggtcagccacgatctcaggaggatgtaattcaagtgagaaaataaggcacaatacagtatttccctccttctgatgtgcatattaattgtggccttataagtttgaaaacttgtgcaggagagtggtgctggttttattcccctccagatataaaaagaaaaatatataagtgctctgaatggaccacagctgaaaatcaagtgagaaacccaccagcttgatatcctcttaatagagaacactcaagaatgtggaaagagttctccaccagtctctaaaaaaaatcaagatggatactcattttcttcctccttattgaggcacttctagggcatcactctacatgcagtcttttaagaaagcctgaagatggtggaagatttagtataaacgttgacaaaaatgctaagatttagtataaactttgacaaaaatgctaattgctatttgcaaaaaatgctaattagctaaagaattagctaattgctaattctaaccaacactggcatttttcctaatttattttcactttagaaagcaatagcaaggtgttcagaagacaagatccaaacctggagaaggtccaaaggagaacgcggggcaagagagaatgcaggatgaaaagggaacatgtgtgggagttgaggctatttgggtgaggcgattgttaactagccctaggctaaagtcctgccactcatcctcgcagacaaaggctctgatgccctggacttcatgctgtgctggaccactgtcccttctctggggctgtgggtgccacctagaccctgggggcagagagatgcaggtggacttgaccctagctcttctcttggggccagacaggagtatttcactcacctaggaaaatagtattctaccattatgtatgatactcttttatcatgaagcacaatgttagttgtaggttttggtagatattctttatcaagttggggaagttcccctctattcctagtttactgagtgcttttatataatcatagaatttttcttttttagtctgttgatatggttggaaatgttgaatgatctttaaatgttgacccagcctttcatatgtgacataaatcccacttagtcatactatgtaattctttttatacattgttagattcagtttgttagtattttgttgagaattttgcatctaagttcctattagatcctagtccataatctgtagttttctttcttttttttttttttttttttgtactgactggttttggcatcagggtaataatgacctcataaaataagttgagaagtattatctcctattctgtgttctggaggagattgtgagaattggtgttatttctgtttaggtgtttggtagaaacaaacaaaaccatctgagcctgcagatttcttttgaggttttaaattatgaattcacattctttaatagttataggagtattcagatgatctattttgtctttggtgcattttgttagtttgtgattttctttttcttttcttttttttctttttctttttttttttgagatggagtctcgctctgttacccaggctggagtgcagtggtgcgatctcagctgactgtaacctccgcctcccaggttcaaaccattctcctgcctcaacctcccgagtagctgggactacaggcgtgtgccaccacgtccagctaattttttgtatttttagtagagacggagtttcaccgtgttagccaggatggtctttatctcctgaccttgtgatccgcccatcttggcctcccaaagtgctggggttacaggcatgagccaccgcgcccagcctggtttgtgattttcaacaaattggtcaacttcatctaaattctaaaatatatttgtgtagaattgtttgtattattatcttaccaaccttttggtgtcttcagcatctgcagtgatattccctgtttcattttttacattggtaatttgtacctttttttctttgtcacacttgctagaggtttgtcaattttattgatcctttcaaagatctagctctttgtttttattgatttttctttattgtttttctgttttaaatttcattgatttctgctcttagacacaggtcttttgggaactcaccatctaacagcaaaaacttgtgtaacaaataattataattgtataatcttatttacttgaaatggccagaaaaagaaaatctatagacacagaaagtagattagtggttatccggagttggaggtggatatgggcattaactgtaaatagagcctgagggattttattaaagagaagaaaatattttaaaacttgattatggtgatggttgcacattttggtaaatttactaagagtgattgaattgtacacttgaaatgggtgaattttatgatgtgtagtttgtacatcaatgaagctggaaaaacaaataataaggatataatatgaataaatgcaacagtaaaacgatgtagttgtcttagccccctctaactgccaaggaaacagaggactagttattatagggttagcatatgaatctagtcctattgtgccaagattagtcatcagctgaggcaataataagagacatagaggtatatgccaggaaatagatatccttcctacaagtggaggttattcctctttcagaatggtcctcacccagtggcgcagagattaccctgagtggtgattccacacacatactgctagctgtacaagccagttagcctctggcagacgctttggcttgatcagcgttcttagtttcaagcaacaaataccaattctgagtgattgaggtgggaaagaaattggacagctcacagaatcttgtgaaggttgagaacaaaactcaaagctctgtagccaggaatgttgcccaaaaccatgctgtagattcagtccagtgagaagactgctttaactaatgctactgagtgtcctggactctgccccttcctctccaccactactgctctgggagatcaatttgcccacgactgtggctgttgcaagacagagaactcactactatcctagcttttatgtgactagctccttactcaaattcctatgcaggttttttgattggtggggtgtaggccacacaactacatccaggctgtgtgggaggctggtaaagtgagtatttgataccttctatcagcttccatagtgtgaaccaggctgaacttttcctcaagactcatatgttggttaattccctagacgcagagagtgagttccgatattggaccgtaaatacacacacacacacatatacacacacacacccctttccactgcagccttgctcaaactgtagtagtccacagaccagcaggtttggcaccaatgggaagcttgtcagaaatgcagaaactctggtcctgctctagattttcaaaatcagaatatgctttttaacatgcacctcagataatttgcatgtacacaaaagtttagaagtgctgctctactttatacaatatgtagtcctttttaattttcaaagatcagtcaccactactctctactgatccacagggttgctagagttaccaaataaaaatacaagactcccagttaaatttgattttcaaaataaacagcgaatcatttttttggtataagtatgttctgtattttatctggcaaccctacttatccacatacccctccccccatgattaacaaaatgaacaaaaagaaacagaaatagacaaaacagcctacaggaatgcatgcacaccagttttctattttggcataggagattataaacagcatgtcagcagaacatgtacactctatacactttcaagcacactgagttctgcataagcattccatgcctgaggtccctataatttgaagggtgagtcacttcctctattaactcttccataggttaaggtcgtttctgtttttcaaaaatatacctattaattgcaattacttttacttaatgaattttgaccaaaagtacttttatcccacagactttagtttcattccttcaaaacaggaataaactggatcttaaaataaatacagagagtatgtgtaaataaaatatgaaaaaatatgtgctggcttccctctggagaatgcttcagtttttcctaaagaaaagagttgtcatccatgtccaggagtcttagaaaaatagctttcaaatattctagctaggaaagaggcagattgcatgatgtatcaattagaattagaagtatcacgtgcaaaaattaaagaaaactttcagtactccaaaatacctgccaattgcctttattcataaggtggctcaattcaccctaatattttagctaatacaaatattgctaaccaaagcaaccaaataggtagttttgagtggttgggagagaatgactttctgtttacaattcttaagagtaaggaagtaattttctagatagcaacttcttgcacaggtgaacaagaaataagccaccttcaatgaagcctaccaacaaaaatctttcagtaatcatattctcataaagtcttatcctcttgactgatgatgaaatgtccaggaattgtcagagggattatagtttcaagaagcagaatatccttaggggctaatgagtatcagggattaaatatatacatatcctccctcaccacaaagaggttttatttcatgtctgttaccatcttttaattcattgtttgtaagccccattttagaggcagatgtctctaataggcaaatgatataccctagtttattttatgtgccaggccataaatgagccaattgactaggctttcgttaaacattaaatagaattgaggtaagatattacaagatactcctggaacatcctgtcataccagaaattaagtaccaaagaccactgaatcatgtcaaaaaggactcaagggccaacttgaagattcaaagagaggacaacttgaatattaattagtacaataactataatgaattagaacatatcaaatctatttcaatgcatttgttcagattgatattctaaaacaatgctagggaatcagcttattattttgaagactacaaaataaaagagaatgaaacaagtaattattccacctttcatatgcatgatgtacctcagattaatcatagttactaaaaggacatttctcttcacagaagtattccaaataatacgtgaagaagaaacgatagaaattattatccccaatgaaacagtgtggatggaaagaatctgcaatggtggttaacttcacaacaacagacaagcaggtattattgccctgatggcacatatacaacaccacatatgaagtattcttgcaaaaattcaaactaaactctgatcaagcctttaaatgtacataataatttacagaaaatacagaggataaataacacattaaatgataatttttttaaacctagactatggaaaattctataggacagacattctagtattgcctcaacacataaattgaaagagaaggagggaggcattctagattcaaagatgcttaacacatattaaacaaacatagtgtgtggtacttatttggatctcaatttgaacacatcaactgtaacaaaattattcatgatacagctgggggaaatctgaacactgactgttgatgttattaaaaattataaaaattataggtatattaatggtattattgttattttttagaggtgtccttatcttttagatatgtatgtgaaatatttatggataaaattgttaccagatctttagggtattaattttcttcccagaaacctctgtgactggtggcacctttgcccgaattcttgacctgtgtccaggaagaatgaggtatgcagacaagtgaagggtgaataagatgaagaggagctttatttagtgttagaacaactcagaggagacccgcagtgggcagatcctctctaggcaggtcatcctgtggagtgttcagctctcaacagagaagaggccctggagaagctggctcctctctgctggcaggtcattcagaggtctctgcgggtctctgaagctctcagcagagagggtagctcctctctgccactggtcattccatcatctctctgtcctctgccctgctctggctgagcctgggcttttatggaactcagaggggaggaagttcataccgattggtccatgggcggccatgggcagcctggaagaggcaccacaagaccccactctggtcagcaggtctggcaggctggcctccagccttcaggttctccctggcctgaagttggggccttacccgggacccatcccttcctgcccaggagcctgtctgcttcctgctgctgcctatggcgcccagaccgctagagccaaggggcacctgcaggccagtgctgagctgcccccagccccatcttggcctccctcttgtgctcattggtgcctaaagtttggagggtcccagacagcagggggcctgcgtgtcaacactgcaccgagcctgtgcacaccagtccagggcgggacagagcaggagctcagccccaacccggctccaagattagagggagtactgggagcagagagaagccaggcagcagcagaaaacacgcacgagcctgcggggacacagggggctagggccttccagaccctcgagggtgcaggttgcagagccgccagggttctgcacctaggagcatggctgcagctgcatccagggagctccagtccagccaattcagaaggggcgggacttccgcttgtccccaactactgtctgtggagtggagagagacgcccgcgtttacaaccacaggtcaggcagctgcagctgtatttgagagggcagagatcctgcctgctcctggcacccaccaagagcacagggaggttcagatatacagctacagtttgggcagctgcagccctacccaggagggtggggctcctgcctgctccatggagtgggcagccccagccacgcctccctgctgcagccgataccatcaatatgaattgatatctgggatttgcttcaaattaatcaagaagtaaggagaaggcaaaattggctgtgagttgaatatttgttgatctaaatggtaggtacacagaggttaattatactgctgtatccacatgataagggtataaattttttcatataattaggttataaactcgtacttaaaataagatctcattttcagttttgaaatatatgctatatgtgtacacacacacacacacacacacacacattagaaagaaaagaaaatataccaaaagtccttactggctgtttggtgggattagaagtaaaacataagtttttattggtttctatatttctcattatggaaaacatttttaattgagacataaaattcacacaccataagagtaatcattttaaagtatacagttcagtcgtttttagtatattcaaaatattgtgcaactgtcatcaatctaatgccggaacattttaaccaccctgaagaggaaacttatacccattaagtagtagattactaacctccttttcttccccagctataagcaacctccattcttgatatttctatagatttgcctattctgtacattttatataaatggagtggtacaatatgtagtttcttgtcattggcttattttacacaccatcatattttcaaggttttctgcaaaaaaggggggggcattggcattttgataaatcttgtgagtattgccatcttaacaatattaaatcttctaattcatggaaccagatatctttgtacttaaatcttctttaattcttctctgtaatattttgtagttttcagtgtattaatcttgtacttccttggttatatttattcctaagtaccttatcctttatgagacaagtttcagtgcaattgtttccttaactttggttttgggttattcaatgacaatatataaaagagcaaccatttttagatatgtatgcattttattaagatataattcatgtaccatagaatttacccacacaaagtctataattctatgttttttatatagtcacagatacgtgcaaacatcaccacagccaattatagcacattttcatcacctcaaatagaagctgtgcactttatgtgtgattcagtgtctctccattatcccaaaatgtgatctaccactaatcaacttgctgtctccctagatttgcttattctgtacatttcatataagtggaattaaagaatatgcaagtttcgtgtctggcttttttcactaagcataatgttttcaaggtttttttttttttcatgtggtagcatgtagctatacttcactactttttatggctgtataatattccattttatggctatatctgattttgttcatccatttatcagatgatcatttaggttgtttttactttttgtctattaagaataatactgcttagcaaagacatggaaccaactcaaatatctgccaatgataaactggattaaaaaaatgtgatacatattcaccatggaatactatgcagccataaaaaagaatgagatcatgtcctttgcagggacatgaatagagctggaggctattatccttagcaagttaatgcaggaacagaaaaccaaataccacatgttctcactgataagtgggagctaaatgatgagaacacatggacacatagaggggaacaacacaaaccagggccttttggaggatggaaggtgggaggagggagaggatgactaaaaataattaatggatattaggcttaatatctgggtgatgaaataatctgtacagcaaactcgcatgacacatgtttacctatgcaacaaacctgcacatcctgcacatatacccatgaacttaaaataaaaactacaaaaagaataatgctgttatgaacatttgtggatgcattattgtttgaaaattttttttaattctcttgggtgtatacctaggaagtgaactgatgagtcacatagtaactctatgctaaactttgcaaaaaactgtaaaaaattgttttccacatcagctgtactacagaatgttctcaccaccctcgtattagggctccaatactccacatccttgcaaatactagtgttgttaaaaaattttaataataactaccatagtggatgtgaagtggtatctcattatggttttgatgtgtatatccctaatgactaatgatgttgagcaccccttcatgtgcttattggccattggtttatcttttttgaacaatgagaacacatggacacagggaggggaacatcacacaccggggcctgttggggggtgggggtcaaggagagggagagcattaggacagatacctaacgcatgtggggcttaaaacctagataacgggttgataggtgcagcaaaccaccatggcacatatacacctatgtaacaaacctgcacgttctgcacatgtatcccagaacttaaagtaaaataaaaaataaataataaataaataaataaataaataaaggaatctgaacttgaaaaaaagaaaaaatgtctattcaagtcctttgcccatttttttctgaagttgcccatttttttattaagttacaagtgtttttatgtattctggatactacaactttatgaaatatgtgtcttgcatatattttctccatccactaagttgtcttgttaccttcttgatagtttcctagaggcacagaacttttacaatttgatgaaatccaatttatctattttttcttttgttgtttgtgatttcaatgttatattaaagaaatcattgcctaatacaagttcatggggattcacacctgtgttactttctaagaattttagagtgtttaggtcttacatttgagatctttgatccattttgagttaatttttgaacacagtatgaggtagaggccaaatacattcttttgcacatggatatccagttttcccagaatcattttttgaaaagattatattttctctattgaattgtcatggtaacaaaatttaaaatcaatgtaccataaatgcatgggctttttcctggactctcactatatgtcactgctttgtttttctttttaatcccatggcatgaccacagtgtttcgattactgcaggttgataatattttggaattgagaataataagttctactttgttattctttctcaagattgtttttattcttcaggatgcttttcaattacatatacattttaagatcaggtcatctatttctgcataaaaaccagatcatattttgataaaccttgaattcaaactgtaaataaatttgggaaatattggcattttaacaatagtaagccttttagtccataaaaatagatgtcttttcagttaattatgccttcttgaatttctttcaacaatattttgtagttttcagtgtacaagtcttgtactcccttggttaaaatgattcctaagcagtgtacctttttagaaactaatttatttttaatgctttttaaatatattttttaaaaatttatttttaattttgtgggtacacagtagatgtatatatttatggggtacatgagatattttggtacgggcatgcaatagatagtgacaatatcatggaaaatggggtatcatcacctcaagcatttatcctttgtgttacaaataatccaattacactcttctacttactttaaaatgtacaattaaattattattgactatagttcctttgttgtgctgtcaaatactaggtcttactcattctttctaactatttttttgtacccattaactattcttacctcccaccccctcccactacccttcccagcctctggtaaccatccttctctatctccaggagtttaatcgttttgatttttagagcccacaaataagtgagaacatgtgatgtttgtctttctgtgcctggcttattcacttaaaataatgacctccagttccatccatgttgttgcaaatgactggatctcaatcctttttatggctgaatagtactccattgtgtatatgtactacattttctttatctattcatctgttgatggacacttaggttgcttccaaatcttagctattgtgaacagtgctgcaataaacatgggagtgcagatatctctttaatatactgatttactttcatttggtatatacccagcagtgggattgcaggattgtatcatagctctatttttagtttttctgaggcccctccaaactattctcacttcttcctattttcaaatttactttcataggggaggactttttcctgaagatgtatgtatgatgttgtttcggtagggtacttcagctttgattctgggtacatgcagtagtgtagtctttgtatgatttatttggctgtcaacagtgttagtaatacccgtgattttcttggtgggtaagagtgtgattattagtggaggctgtggtgaagttgtgctggggactgagatggcaggcgggccagtcttcagggcccagtggtggcggtagcgggctgagtgaacttatctttgtgctgcagggcagagtgcactggaacctttgttggcagtctggcaggtctattcttttgccttagcatggcttgatcagatgccagtactggaagcagtggactgggcaagttggcgagttctcaggtttctgggcagctggtgtggtttgggcaataagagtagcaatggtgaaatgattctctgggtcacaaagtgtgtggattgatattggtggtggctgcaattggcttggtaggacagtctccaggcctgcagggggtagtgcctgcaggtaggtgccagctgaagtggtagcagctgggagtttaaacccaacgtcaggcacccaggaggagtgctcaggtgtccaaggtattggattgagtttggcaattcctgggaccccaggctatgtcctctgtcttgtggggattgagggagaacctgggctaagaaggttgtactcaggtcccccagtggtgagagtaggcatcagccatggagggcaggggcaggaagttcctcaggccccatctgtagtgcttgagtgaggggtggtagcagctatgcagaggctctgctactggagaggatggggcctcccttagtggtcatagcctgggctgaggaatagggaatgtgtatttccttcacacccaagtccctgtggggcttaaccacccccccattcccctatccctggctgtaggagcccactgtcagcttgtgatcaagtcccagcagcaacttatgtcctgcttatgtccctgtcttagattccagcaccagctgctgctgcccgggtgttggtcacttcctaaccctggctgcaggagtgcttccagctcactcccacatctcagcagtgatagcccaagtttccataacacctcagttccggtgtttctaggacttattattttcttaatttttgtttcaggttgttcaatgccagtatatagaaatattactgtcttaaaaaaaaaaaaacagctttgggctgggtgcggtggctcatgcctataatcccagcaactttgtggggctgatgcgggtggatcacctgaggtcaggagttcaagaccagcccggccaacatggtctctactaaaaatacaagaaaatagccaggtgtggtggcgggcgcctgtaattccagctcctcaggaggctgaggcaggagaatagcttgaacccgggaggtggaggtcgcagtgagctgaggtcgcgccattgcattccaggttaggcaacaacagcgaaactctgtcaaaaaaaaaaaaaggtattgcctaggttttcttctagggtttttacggttttaggtctaaatttaagtctttaatccatcttgaattaatttttatataaggtgtaaggaagggatccagtttcagctttctacatatggctagccagttttcccagcaccatttattaaatagggaatcctttccccatttcttgtttttgtcaggtttgtcaaaggcaggggaagggatagcattaggagaaatatctaatgtaaatgacgagttaatgggtgcagcaaaccaacatggcacatgtatacctatgtaacaaacctgcacgttgtgcacatgtaccctagaacttaaagtataattaaaaaaaagaaaaaaaacagttgtattggcatctaaatcaaatatacacacatttgacgcatttaaactataaaatttaattgtttttgcctagttgcagatatactaccataaccacacgcagttgtcagagactagttttcaaaacggtgcctgactgtagctgcttaggtctcagcaagggtatgggacccagtgtgatctccctccctggagcaattctgacccacagtctcccagcagcttcctatgttagtttcagaggttgggagggacaaggatttctgtggccaggattgcatggttccatgttggggatgtgggtcactggtagactcttactcaccccttctctgcattgggaagtcactcctggctcccagccaatcctggccagggaggctgcctctcctccttctcctttcctacttttggtattttccttgatattgtctttgaggcctagagttttttcttttgaagaatgctaatcatctagtttttcttttgttccttgtgattttgttatattgaagaaactgttgcctaatccaagatcatgaagatttacaccatgtttccttcgaagatttccatattttcaggccttacatttaactctttgatctattttgagttaatttctgtatgtagtctgaagtagggaccatgtcattcttttgcatgtatttatccagttgtcttagcaccatttgttgaggagactatattttccagattatattttcttttctctttttttgagatggagtttcactctttgcccacgctagaatacaatggtgcaatcttggctcactgcaacctccacctcccgggttcaaataattctcctgcctcagcctcctgagtaactgggattacaggcatgcgccatcacacccggctaattttttgtatgtagtagagacggggtttcaccatgttggtcaggctggtctcgaactcctgaccccaggtgatccacccacctcagccccacaaagtgctgggattacaggcgtgagctcctgtgtccggcccagattaaattttcatggaaacctcatccatcaaaagtatttgactacatatgtatgggtttattcttggacaatcatagtatcccaccagtctgtttattttttatccttatgtcaggaccacagtgttttgattattgcagctttcaggtacactttaaaattagaaagtgtatcctcgtacattgtttctctttttctagatttttggctgttcagtgatcttcacaattccatgcaaattttagtatcagctcacccatttctgcaaaaaggctggtgatatttttatagaccttgcattcaatatgtagacatattttggaatattgccatcttaatattaattcttctagtcccaagaagaaaccacaatgtgtttctccttatgtgggtcttctttactttaaaaaaaatatttgcacctctctatgtacaagccttgtacttccttggttgatggtatccatttaggtactttttttttagatggagtgttgctctgtcacctaggctggagtgcagtgacgcaatctcggctcactgcaacttccgcctcccaagttcaagcagttctccctgcctcagcctcctgagtagctggaattacagacacccgccaccacacccggctaatttttgtatatttggtagagacggggtttcaccatgttgaccaggctgatctcgaactcttgacctcaggtgatctgcccgcctcagcctcccgaagtgctgggattacaggcatgagccaccatgaccaggccctattccatttttagttaagtgaaattattttcttaatttttgtttcaggttgttcaatgccactatatagaaatgctactggcttaaagacagctttattggcatataaatcaaatacacacatttgacacatttaagctgtaaaatttaattgcttttgtttagttccaaatatactaccataaccacagtttttttatggcaccattcaattgcttcaaaagaaaccccatgtattttaggtatcattgccctcttcttccattccacagctctactgaatcacaaatctatttcttgtctctatagatttgtttattccagacattccttataaatgacatcacaaaatgcataggtttttgtacctggcttccttcacttaacagattgttttcaggttttacccttgttggtagcattagcagtccttcattcctttttatagctgtataatattctattatatgagtatatctcattttgttcattcattcatcaattgatgaacatttgggttgttgccactttttctgtattgagaataatgctggtggctcatgcctctaatctcagcagtttgagaggccgaggtgggaggatcatttgagtctaggagtttgagaccagcctgggcaacatagggagaccttgtctctacaacagaaaaaaaagaaagaaagacagaaagaaaaaaagctagccagctgtaatggcatgtgtctgtagtcccagctactctggaggctgaggtgggggtatgacttgagcccaggagtttgaggctgcagagagctgtgactgtacaataccactgtgcttcagcctaggcaacagagcaaaactctgtctcaaaaaaaaataatgcttctatgaacatcagtatataagttattgtgtaaacatgtttttaattctcttgggtatatacctaagagtggaatttctgggtcacatggtaaatctatgtttaactttgtgaggaattgccacatgtgttccacatcacttgtaccattttatattcctcacaggattgtaggatggctcaaaacattccacatcttagctaacacttgttttatttccttttaaattatagctatcctagtgggtgtgaagtggcatctcactgcagtttctattcacatttccctattgactaatggtgttgattatattttcatgtatctatttgccatttttatgtcttctttggaatagtgtctaattgggtcctccacccttttttttttttttttttgagacggagtttcactcttgttgcccaggccagagtgcaatgacacgatcttggctcaccgcaacctctgcctcctggattcaagcgattcttctgcctcagcctctcaagtagctgggattacaggtgtgcgccgccatacccggctaattctgtatttttagtagagacaggatttctccatgttggtcaggctggtcttaaactcctgaactcaggtgatccactggctttggcctcccaaagtgctgggattacaggcataagacactgtgcctggcccctccacccattttatacagggctgtttttctttttgtgtttgagttgagagatttctttatgtattctcatagtagagtcttatgagacttagaatttgcaaacattttctccctctatatgggtcgtattttcactttgttgataatattttttgaggcacaaatatttttacttttaattaagtccaattcatgtgttttttcttttgttgcttcagcattgggtatcacacttgagaaattgttgcctaatccacaatcataattatttacatttatgctccttttaaagaattttttaaaaacttttattatttaaaaaataataatagtagtaaaaacagagcaagctcttattccctgtccctgctccaaaaatccccaaaatacagaatgtttcacaaattatcgtgtcatccttgctcaagggccatgctaatcttctctgcatcgttccaattttaatatatgtgctcccgaagtgagcactcttttaaataattttctggttgtagatcccacatttagttctttgatccattttgagttaatttttctatatagtatgagataggggccaaatgcattcttcacatgtggatattcagttgttccagaaccattggttgaaaagactttttccctattgaatgattgtggcatccttataaaaatcagctttccattgatgtatgggctgatttctggacccttgttctgttctaccactgtatatttctatgcttatggcaggactataaggttgtgattactgtagttttgtagaggtgttgtgttgtaagttttgaaatcagaaactgtgagttcttctacttcgttcttttcccagactttttttttttttttcggacattcagggtccattgcaattccacatgaattttaggatcagttagttcatttctgccaaaaacagcatcttgtatttttatacaccttgcatttcaactgtagatcaatgaggactattgctatcctaacaatgttaagtattgttgttcatgaaactggtatggttttccacttatataggtctcctttaattgctttagatagtatttgttagttttcaaagtactagtcttgcactttcatggttaaatttattccaaagtattttatccatttttaaattattattattatttttttgagacaaggtctggctctgctgtccaggctggagtgcagtggagtaatcttggctcaatgcaacctccacctcctgggctcaagccatccttccacctcagtctcctaagtagctgagactacaggcacttgccatcatacctggttaaattttggtagctcatgcctgtaatcccagcactttgggaggccaaggtggcgggcggatcacttgaggccaggaattcaaaaccagcctggtcaacatggtgaaaccacatctctactaaaaatacaaaaattagccgggcatgatggcagatgcctgtaatcccagctactcgggaggctgaggcgggaggcagaggttctagtgagccaagatcgcgccaaaccattgccttatccaaggtcacgatgatttacgtctatatttccttttaagatttctagagttttaagtcttatagttagatattgaatcctctttatgttaatttttgattatggtatgaggtaggggacaaaattctccttttgcttttgaataccacagccatttgttgaaaagactttttttttcctcattcagtggttatgacaccctcatcaaaagtcaattgaccataggctgggtgtggtggctcacacctgtaatcccagcactttgggaggctgaagcaggcagatcacttgaggtcaggagttcaagaccagcctgggcaacttagtgaaacccgtctctactgaaaatacagaaattagctgggcatggtggtacacgcctgtaatcccagctacccaggaggctgaggcaggagaatcacatgaaccagggaggtggaggttgcagtgagctgagagtgcaccattgcactccagcctgggcaagagagcaagactccatctcaaaaaaaaatcaattgaccatagatgtgtgggtttatatctggactatcattgtattccacttctctatgtttctatcctatgctttgtaacaagttttttttttttttttttttttttttttgcgacagagtctcactctgtcgcccaggctggagtgcagtggtgcaatctcagctcactgcagcctctgccctccaagttcaagtgattctcttgcctcagcctcccgagtagctgggattacaggcacctgcgaccgcgcctagctaattttttgtatttttagaagagacagggtttcaccatcttggccaggtggtcttgaacgcctgtcctcgtgatccatccgtcttggcctcccaaagtgctgggattacaggtgtgagccaccgtgcccagtgtttgttttttttttaaatggagttttgctctgtcgcccaggctggagtatagtgatgcaatctcagctcactgcaacctctgcttcctgggttcaagcaattctcatgcctcagcttcctgagtagctgtgatcacaggcgtgcaccaccacgtctggctaatttttatttgtttggtttttttgtcttttttttttttaagtagaggcgtggttttgccatattggccatgctggtcttgaactcctggcctcaagtgatccgcccaccttggtctcccaaactgctgggattacaggcataagctaccatgcccagcctgtgataaaatttgaaattaagaaggctgtgttcttttacattgttctttctcaacactgtttttgctctttagggtactcttcagtttcatatggattttaggatcagttcatctatgtttgggagaaaaggcagatttgaaaggtcttgtattctatctgtaaatcaatttggggagtttgccatcttaataatattacattctctagcccatgaaactgggatggtgctccatttacttatatcttctttaatttatttcaacatattgtagtttttagtgtacaagtttcacaatttcttggtgaaatttatgcctaagtgttttattagttttgattctgtttgaaatgcaattcttttcttagttttgcttttggttattttatgctagtatataggaatacaactgtttttcaaatagctttgtttgaaaagtcacctgtttaaactctgcaattcaatggtttttagtatattcacagatatgtgcaccatcaccacagttgattatgacatattttcattgcctcagtcagaaatcccgtagtctttagtcatcatttttctatcctacataacctttaatcataatcacccactagtttacttgctgtctgttaaatttgccttttcttcatataaatggactcatagaataagttgtctttgtgtgtgacttttgcttttttttttttttttttgagatggagtttcaatcttgttgcccaggctagagtgcaatggtgcgatctcagctcaccacaacctctgcctcctgggttcaagcgattctcctgccttagcctcctgagtagctgggattacaggcatgcgccaccatgcccagccaccatgcccagctaattttgtatttttagtagagatggggtttctccatgttggtcaggctggtctcgaactcccgacctcaaatgatctgcccccctcggcctcccaaagtgctgggattacgggcgtgagccaccgcgcccggccgtgtgtgacttctttacctagcataatgttttcagtgtttgtctatgtgatagtatatgtcaattcttcattccttttttaggctatacagtattccattgtatggatatatcccattttgtttagaattcatcaattgatggacatttgggtttttctgcttttggctattattaataatactgaacattcatgaaaatttgtggacaagtattatgtaagcatgttttcaattcttttgggtatacacctggaagtggattgtttggtcatatggtaactccatgtttagctttgtgaggaactgcagaactgttttccccagggactgatccattttagattcccatccactgtgtatgatggtttccatttgtctgcatttttcctaatacttgttttttaactttaaaaaaactgtagctttccagtggatgtgaagtaatatctcattatgatttagatgagcatttctataatgactaatgaattgcctatcttttaatttgcatatttattttgtgtatctttggaaaaatgtctgttcaagttctttgtctacttttaaagtgggctgttgtgagagaatcctttatatattctggataccaccttcttatgagttatattatttgcaaatattttctccctttccgtggattgtctggtcaactttcttgatagtgtccttcaaggtacaaacattgttaattttaatgaagcccaattcatctactttttattttcatacttgtacttttggtatcataattaagaaaccattgcctaattcaaggtcataaagatttagtatgtgttttcttctacagtttcatagctttaggctgtatttaggtctttgatccattttgagtgattttttttttgtctatggtatgggatagagaccaaatacattatttttcacatgaatatccagttgtcacagaactatttgttgaaaacactattgtttcccattgaatcagtgtagcacctttgctgaaaatcaattgaccataaatttataggtttatatctagactcttattctattccattgctgtatatttcttttttatgacagatctacactgttttgatttctgcagctttgtagtaagttgtttaattcagtagtgtgggttcttccccattgttcttttccaaaattgttttggctattcgaggatttttggaattacacgtgaattttaggatagacttgtctatttctgcaaaaaaggcagacttgtctatttctgtaaaaaaggtattttggtaggtcatgcattcaaattgcagacaaacttggggagaatcgccatctcaaaaatattagctttctagttcatgaaactagattggttttccacttatttaggtcttctaaaattttgttcaagaatagcttgtattttccagtgtatgagtctttcattttcttggttaaatacgttctctaatatttttatcctttttgatgctacttttttgggggtggtaatggatttttaaacagccttattgaactataattcacaaacaatacaaatcatccatttaaagagtacagtgcaatggtttttgtatattacattatttttaaaaaacaacttgtggcaaaatatgtgtaatataaaaattgcaaattttgcatcttaacaattttaaggttacaattgagtggcattaaatgcattcccattgtagtataaccatcaccactatcaatttcataattttttcatctccccaaacagaaagtgtaactattgagctccccattacccttgtcctccagcacctagtaacctctattatacttcccctatatatacatttgtttataaaggatacctcatataagtggaatcatgcaatatttgcctttttgtgtctggcttatttcacttagcataatgttttcaaggttcatctatgctatagtatgtatcagtatttcattcttttcttttttgacggagttttgctcttgtcgctcaggctggagtgcaatggcgcgatgttggctcactgcaacctccttctcctgggttcaagtgattctcctgcctcaactcctcgagtagctgggattacaggcgcccactaccctgcccggctaatttttttatttttagtagagacggggtttcactatgttggccaggctggtctcgaaatcctgacctcaggtgatctgcccaccttggcctcccaaactgctgggattacaggcgtgagccaccacacccgacctgttccattcctttttaaagccaagtaatatttcattgtgccatattttattgatccattaatctatcaatgggtacttaggttgcttccaccttttggttattgtgaataaccactgttataactatgggtataaaaatacctgtttgagtccctgctaccaatacttttgggtaaatatccagaaatgaaattggtagatcatgtggtaattatacatttgacttgagaaactgccaagctgttttccacagcagctacactattttacttccccaccagtaatgcacaagggttccaatttctttacattctccccaacacttgttattttctcctttttttctgaatagccataatagtagctgtgaagtggcatttcatgtggttttgatttgcattagaatgatgttgagcatcttttcatgtgtttataggaaatttgatatcctttttgcagtagtatctgttcaagtctttgtccatttttaaactaggctttttatctttttgttgttgagttggggacattatttctatattctgaacactagaaccacatgagatgtatcattttcaaatattttctcccattctgtgagttgtctcctcattttcttattacttactgggtacatagtacatcacccctttgatgatgaaaggatttgaggtggtggttgcacagcattgtgaaagtagtagatgccgctgaattgaacccttgtaaatggtgaattgtatgttaggtgaaatttcaccttaataagaataaacaagaataccagcaaggtttagggaaatccttgtatctaccaatgttaaaagagtaaatgtaaacaaatgttctgccaggaacccccagaagtgggaaattctttccagctgttagaggagaataatgagagttcaactgtgattggtgtgtgattacctgaagggtttgattgttattaaactaatttttccatcatattgttccttctagtcccaagtggacagagatattataggaaatacactggtgggaataatattttctcattgaaaagggcatatgtggccaggtgcggtggctcatgcctgctatctcagaactttgggaggccaaggcgggtggatcacctgaggtcaggagttcgataccaggctggcaaacatggtgaaactctatctctactaaaaatacaaaaatttgctgggcgtggtggcaggcgcatgtaatcccagctacttgggaggctgaggcaggagaattgcttgaacccgggaggtggaggttacagtgagccgagatcacgctattgcaccctaacctgggtgacaagagcaaaactctgtttaaaaaaaaaaaagggtagaagagcgcatgcaaaggccccattagagcatgaaaaaaaaaataccctgttataatatcaaatgattgataaatttcattccagctcccattttttgagtgtctaacttattagctgaatagtgtagaaagatgcctggcagccccaatcttcaaggaattcacagtataatgagaaagaaggaagtataaaatattctgggcaataatagacatgaaaaatttcacagctaggcgcagtagctcacacatgtaatcccagcactttgggaggctgagggaagagaatcgcttgaggccaggagttcaagaccagccttggcaacatagtgagaccctgtctctacaaaaagtataaaaatttagccgagtatggtggcatgcaccttcagtctcagctactcaggaagctgaggagggaggacctctttagcccacaaggttgaggctgcagtgagctgtgattgtgccactgcactccagcttggggaacagagtgagtccctgtctgaaaaaaataattttttttcactagtcagtcccactgcaggagctgtcatgactgaggatttgggcagatggctatttcttcctctaagtcagtatgtttgggaagggtaagaagctgactctccattattcttaaaaataggcatgaatcagattagattacatgtctcctccttttctcaggatttccctatagctctgccactgagctgtggaatcttaccactgggatgaggccttaaaagttatctaatcctggccaggcgcagtggctcatgcctgtaatcctagcactttgggaggccgaggtgagtggaccgcctgaggtctggggttcgagaccagcctggccaacaaggcgaaaccccgtttctactaaaaatacaaaaataaaatagaataaaataaatttagctgagcatggtggcatgtacctgcagtcccagctactcaggaggctaaggcaggagaattgcttgaacctggcgggggcagaggttgcagttagctgagatagcaccacttcactccagcctgggcgaactccagttttctgaaactctgtctcaagttatctaatccttctgttcatttcatacttgggtctttgttaccaaaaatgaccaatgggcttgtgtcaattagaaatactaaattacaagtaagagaaaagtcaaatccctctggcctaaccaataaaagtagaactgggtttagaaactatttgtttcagaggttcaaaaatggcaccaaagttagatttctttctgcctatgttttcttgatgtctgctttattttaacttggctctccttgtggctgagatatggctgcccacagctccaagtctcctcgtttctttgagcacatgaagagagggttgcctttgaaattcctcccaaatatgaaagaaaaactattcccaaagtcctgacaaaatcaaccaatggcagggaatgggactatgctgattgatttaaataggaattatgctaatttgcttattttagaattatagttccaggggcgagccagtgcagggatgtgacactaaaggacatggggcggccaccaagaaaagagaggtgaatattggggtggctaccacagggtcttggcttagccattgacaacatcatggaaactcccaccctcaaaatacaattgccttcccctgctggacaactctgttggtaaagaaatattttcatattttccatggaatccaactctgagttccaatagctcttcttgacatgctattgccctcagatagtggctacttcctttaatttattactttggatgtgccttgccttctttcttagcagtgtctcttctgcctgagccttatagatgtttacagcatccagtgaccccaaaactgactggctgtcactggagaaatccttactttcatccccgaattgaacggaaccaaaatttaattgtcttgtcttctctattgcacttgagaggcttcagagggtgcaagccccaagctttggcagtttccatgtggtgttgagcctgcaagtgcacagaagtcaagaactggagtttgggaacctctgcctagatttcagaggatgtatggaaacacctggatgcccaggcagaagtttgctgcaggggtagggccctcatggagaacctctgctagggcagtgcagaagggaaatgtggggttggaggccccacacagagttgctactgtggcactgcctagtggagctgtgagaagagggccaccgtcctccagacctcagaatggtagatccactgacagcttgcattgtatgcctggaaaagccgcagacagtcaatgccagcccatgaaagcagctgggagggagtctgtaccctgcaaagctacaggggcagaactgcccaagaccatgggaacccacctcttgtatcagcgtgacctggatgtgagacatggagtcaaaggagatcattttggagctttaagatttgactgccctgctgaattttggacctgcatgggccctgtagcccctttgttttggctaatttctcccatttggaatagctgtatttacccaatgcctatacccccattatatctatgaagtaacgaacttgctttttattttgcaggctcataggtagaagggatttgccttgtctcaggtgagactttggactgtggacttttgagctaatactgaaatgagttaagactttgggagactgttaggaaggcatgattggttttgaaatgtgaggacatttgagatttggaggggccaggggtggaatgatatggtttggctgcatcctcacccaaatctcatcttgaactcccacgtgttgtaggagggacctggtgagaggtaattgaatcatgggggcaggtctttcccatgctcttcttgtgaaagtgaataagtctcatgagatctgagttttatgtaagggggagtttccctgcacaagttctctttttgcctactgccatccatgtaagatgtgactttgctcctcctttccaccatgattgtgaggcctcctcagccacgtggaactgtaagtccattaaacctctttttcttcccagtcttgggttatgtctttatcagcagcatgaaaatggactaatacactttctgtttatttataactaatctactccattgttaaacatttatcgtatttatgtactttgtttttctagcttttaaaaactcacaattttttcttttatttcctagagtagttgctagaatttttaaactgatacataataattgtacatatttatgggatgcatgtgatattttgatacatatatccatcacctcaaatatttatcatttctttatgttgagaacatttattccaaatcttttttagacattttgaaatatacaataaattattggtaactgtcgtcactctactgtgctatggaacatttggacttgttctttctaactgcatttttgtatccattaaccaacctctcttcatcccccttcccttctcccattctcagactctgataatcaccattctaccttctaccacgatgagattaatttatttaactcccacctatgcatgagaacatgcaatatttgtctttctgttcctggcttatttcacactagtctgccatcttctctgtttgctgggtcgtcaccgttcttgctctaacttcttgtctgttggcatatgagctgttgtgtagtgaacaaaatgagtttggacttggttacagttctgtgaaaagttacaaatcaattttgattcaaaaccatgctgggaactcttacaagtcttagagtgaaggtccagattcatttccagattcattcatattgcttcaaatgacaggatttcattcttttttttaatggctgaataacattccattgtgtatataatatataccacattttcattatctattcatctgttgatgggcacttaggttggttacacatcttggctattgagaataatgctgcaatcaacatgggagtgcagatatcttttcaatatactgattttctttcttttggcgatatacccaccagtggaattgctggatcatatggttgttctatttttagttgttgaggaacctccattctgtttttcataatggctgtgctaattttcactcccactgacagtgtatgagagttcctcctcctctgtaccctcaccaccatctgttatttcttatttttttgataatagccattttgacctgggtgagatgacctcgttgtggctttgatttgcatttttctgctgattaatgatcttgaacatgtttttatatacctgttggccatttgtatgtcttcttttgaaaatatctattcaaatcatttgcccatttaaaaatgggattatttggggttttttttctgctgttgagttgagttctttatgtattgtggttattaatcctttctcagatggatagtttgcaaatcttttctcgcattctgtaggttgtctcttcaatctgttgattgtttcctttgctgtgcagaaattttttagcttgatgtaattccatttgtttatttttgtttttattgcttgtgcttttgtggtcttacctcaaatctttgctcagaccggtgtgctgaagcatttccccaatgttctcttaaagcagtttcagtttcaggtctacagttaagtctttacttttgagttatttttgagttatttttgtatatggtgagagataggggtctagtttaattgttttgcagatgaatatccagttttccccagtatcacttattgaagagattgtcctttccccaatgtatgttcttggcacctttgttgaaaatgtaaaaactcataatgtttagtaaacattccagaagcaaggtccattttatctcataaggaagatgtgagaattaaatggaggacactttaaaaagtgtttagcataatatctgtataatttattacatgctctatacatgttcgttctctttttacttctgtttatgtaacagtaaaatagcagaagaactaacataactaactacatttttgtttaaggggcctttacccattcctgcatgtagctaggataattctagagcactgagataaaatgcaaaaatggcaatcatatagttttttaaactaactctggcattaaaggggaagtatataaacaacaaactatgttttgttaaagatttataggagtattgtgacctgaccaaggaaaaaacagctcccaacctcctcggaccctcactggtgctcagatatctgcagccattgctcgcttcttgattccaaccccttcctctttcccctgcccttaacataaaaagagcctgaaatttgtactcagttaagatggttcttaagttattaagaatggtagtccaggccaggtgcggtggctcacacctgtaaacctagcactttgggaggctggggctggtggatcacttgaggtcaggagttcaagagcagcctggcttggccaacatggtgaaaccccatctgtactaaaaatacaaaaattagtcgggcgtgatggtgcacccctgtaatcccagctacttgggagactgaggcaggataatcacctgaacccgggaggtggaggttgcagtgagccgagatcatgccactgcactccagcttgggcaacagagtgagactctgtctcaaagaaaagaaaagaaaaggaaagaaaagaaaagaaaagaaaagaaaagaaaagaaaagaaaagaacaagaacaagaacaagaacaagaacattggcctgccatcttctccgtttgctgggtcttcaaaataaagtcactgttcttgctctaacttcttgtctcttggcgtatgagctgtcgtgtggtgaacaaaatgagtttgagtcggttacagttctgtgaaaagttacaaatctattttgattcaaaaccatgctgggaactcttacaagtcttaggttttcccttggagaggcacctgttttgaatttctagagtgtgtctttcctgaacaagatgatggacctgttgtcattttttagagatgaggtcttgctctgttgcccaggctggagtgcagtgtcacaatcatagctcatcgtagccttgaactcctgggctcatacaattcctgttattgcctcagcctccgtgttatcatttttatgttcaacaagaggttctgtacatcaggaaaattaaactctatttgtaaaattggagtcactggaaaagttcactgcattaaaaaatcttgagatttggaaattattaggggaaaattggggcaacctagatttttgtgactgaatgcagattgttagagagaggatgcttcatttcctgaaatctgtttaaaaggtgggaggttgaggagaaatctacctgacagggtagttatgagacctaaataagtcaagagtttagcgtgatatataatggttagcttcttcttgaacttgaacctactatagaaaaaaaaataaattttaaaaagttagcttcatttgtaatgtacttttgttttcatatattctaacatttttattttgagaatagcaagcttgaaattatttctctcaacatattgaactgatacttaaacccatatatatccagtgctgtctaactgcaataatgattttaaagtggttagtatgtaataatgtgctgattttttttgcacgaaacacagcatattcttggtgtgtagtataggcaattatttagtgattatgcaattatataccagttgtcttgaaccaaaaatctttctgcacttatgataatgctacatctcattgtgtttactttcctgtttcctcgtcgtgcatatattatttttaatttctcaccaaccatgacttcctcccttagataatatttcgtctcttcctaacttggagtcttgtactctaacttttggatgtctgtactcttgttcttgggctgttgtattagtcctctctcatgctgctaataatggtctcacgctgctaataaagacatacctgagactgggtaaattataaaggaaagaggtttaatttattcacaatttagcatggctgaggaagcctcaggaaacttacaatcatgacagaaggggaaggaaacacgttcttcttcacatggcggcagcaaagagaagtgctgagcaaaagctgggaaagccccttataaaaccgttagatcttgtgagaactcgctcactatcatgagaacagcagcatgggggtaactgcccccatgattcaatcacctcccaccaggtccctcccatgacacatggggattatgggaactacaattcaatatgaaatttgggtggagacacagccaaaccatatcagctgttcacatgggaatcctctccacctttatattttattcgtaaaacatttactgaaattccactatattctagtcactggcactaactgggcaaaagaaaaatgatccattatcattccctgggcagaaggagtgctcagtctcatgaaaaagacagattattgtactataggataattaacactataatagggatggcccaaaacgtagtagaggcacagaagtagaagcaacacttgcttatgaaaccttcaaggcatattccatgccactgaaaatgataatctattgtgtaatacaaaaagcagaggatttatggttggagacatctcccatttctctcaagtgaattactctctctaggcattagatttctcatatttagagcaaaagtcttgaacaagatcgtggttttgaaattgtttcatagactattactaatatgcaaataaagagcttcatggacaaatatacttgtgtattactgggttaaacaaaattaaatttatttgttgttggatttctgagttttaataggttattgcaaattataaacatttacaaaaggaatatacttcttcatatattttttacaccatggaattcttctatatcagttaggaatttagtttgctacataacagtctcaagaaatagtttttaaactcttaacctttaggtctatgcttcattgagattttattttttatatggcataaaatacgggtctaagttgtgtttttattgcatgagattattcagaattttttatatttatttatttttttagagataagggtctctctatgttgcccaggctggcctcaaattcctgagcaatcctcccacctcagcctcccaagtagctgggactacaggtgtatgtcaacgtgcctgacaaggttattgaattttgacagcattatttgttgaaaatgttttttctctcattgaattgccttgtcatctcagttgaaaataagttcaccttatttgtgggtcagtttctggaccctttatcctactccattgatctatgtatttctccttctgtcaatgctactctgtcttaattacctttataataaatcttgaatcaagtagtgtaattcttttaactttgtcattctttttcaaaatttttttgtgtatttcagatcctttgcatatcagttaagaattttagaatccgcttgtgagttttatagggaagtttcctgggattttggttggtattgtgttgaatctattgatcagtttgagaagaattgacattttcatactattgagtcttccaaaccgtgagtatagtatatcttcctatttaagttttctttaatttctcttagtaatcttttatagttttcaatgtgcagatcttgcacattttgcgtcacatttatccctaaatattctatatgtctgatgctgttttaaatatttttaaaatttaaaatgtccagttattcacggctaatatataaaagtacaattgattcttgtgtattgactttatattctgtgaccttactaagcccacttattagttgtagattatttatacaacattctagaagcttttctgtttggacaacatgttatccatgaataatgagagtttattgttttccctttccaatctgaatgcctttttttcttgccttatttcattgactagaatttcttctattcagtatcatactgactagaatttcttctattcagtatcatactgaatagaagtgggatgaatggatagccttgccttattactgatgttaggagaaaagcattcagcctctcatcagaaagtgtgatgttagctataggtcttttgtagttacctttctttagcgtattctattcttagtttgcttagtgatttaatcaggaatgaatgatgcatttttgtgaaatgttttctctgtgtttataaaaatgattatatgttttttatttattcttttattcatatagtgaattacagtgattcatttttgattgttaaatctactttatattcttcagataaacccccatgtagttatgataaatcatcctttttatatagtgttagattcaatttgctaaaattttaagaatttttgagtctttttgaactgtattagtctttagttttctttcttgtaatgtctttatctgattttggtgtcagggtattctgaccttgtagaatgatttgggaagtattctattctcttctattttctggaagatttcatatagaattgtaattatttcttcattaaatgtttgggaaaatttgccagtgaagtctgggaccaaagttttctttgcgagaaggtttttaaactacaaattaatatttgactattgtgattattgatttattcttgaatgaactttggcactttttgtattttaggaaatgtgtacatttgtcaatttcaccaacatcgtcaaattttattggcatacagttttttctatgatttgaatatttgtcctccccaaaactgatgttgaaatttaatccccaatttggcagtatcgagaggtgggtcctttaagagttctttatgtattcgagatactaaaccattatcatatatataatttgcaaatattccctcccattctgtgagttgttttttcactttcttggtagtgtcctttgaggtccatttaaaaaaattgataaagtttaatttatctattttttcttttttatttattgtttataatattcccttattatccttttgatgtctggaggatccatggtgatatctcctttcttatttctgatattggtaatttgcatcttctttctttctcctgatcattctggatacagatttttacattttattggtcttttcaaagaaccaacttttgatttaattgctttatctctgttttttcctatttcctattttattgattttttccccttaccattattatttcctttcttctgcttactttaagttaaatttgttattttttttttgtttcgttttttgtttgtttcttaagagcaaagctgaggtcattgatttgcgggctttcagcttttctaatatagggatttagtgatttgaatactcttctgagtactgcttgagctgcatcccacagctttaattatgttgctttttcatttttcttttagtttacaatactttatagttcccctttcaatttcttgtagcagtgaacttcagggacatgtgtggaatatctgtgcccagtgaaggctgtttcaagtctcaaggtctgaggctctgatggaatgcttagtcatatatgcacaactggccatggcaattgaaactcaggaggctgggcgcggtggctcatgcctgtaatcccagcactttgggaggccgaggctggcagatcacttgaggtcaggggttcgagaccagcccggccaacatggtgaaaccctgtctctgttaaaaatacaaaaattagccaggcgtgttggcatgtccctgtaatcctagatgctcgggaggctgaggcaggagaatcacttgagcccaggaggcagaggttgcagtgagccgagactgtgccactgattgtggtcaggactccaacaacgaaaccaggttcacatacatcaatcttgatgtttgggcaaagcaaccctaacaagatgccatggcatggtgcgttactccaggtgtacagaacaaaacagtcaatccatcagtgacctaaagaacatgctgaaggctacattcccaaggggtggcttggagacatgcaaggagtaagccaccaaacatactgtgttaactccttcttcacaacaaccaaacagaagaattctctattgctaaccactgccactctgaggtacaggttagatatgggagtaagggatggttagggattgggcaccatttggtctactattacacaaaaccaggagtcacttgttttaatggaagttactctttttttttcatttaaaaatataaagactggacacctctgctttgtgtgggcttgctttcccccgatcacgtcaacctttccagctcttggaacagaatccaaagtccttagcataatacacagagccccacctgatctccccacccccgggggactccctgccttcatctcccactgccttcccccttcatggctctgctccagccatgctggcgaacacacaccaggcccctgcctgcttcaggtctttgcctggagtgttcttagaaatcctcatcactgtcccctcatctcctgcatgcctctgctcaaagatcactccattggaggcctcctggccactgtagctaaaacagctgcccctgccattctctgcgccctttcctcacacctgacaatatatcgttaacctgaatatttaattattttttacctgctcctcctccaactcccaatgagactgtctgcaccatgggggcagggactgtttctggttcgctgggaggtcctgaagcctagcaccatgcctggcacaaagctggggctcagtaagagcctaatgaatgaatgaattagatatagatagacagtaggtggaggggaagaaggagggtatttggaacacagtaagatattttattttcagctctaggctatagaggaaatgctcaactaaattcttaacttttctctcaggacttaagtttcaaatgttatatttaataccataaaatttattttataaagatgatttggtttcctcttagaggctaaccttgtctaataagttttttctttctttctttttccctgatgacaagtcacacatttatagaagaaaatttaaatgatgcagaaaggaataaagtagaaagtgaaaagtctactagactggaggttagggatagctgtgtcagcagggcttatcaaaatgtccctgtggataaaatggccacatcaaacggtcctgctctgctgtttatgttctttgcctatttttaaaggaaaatatctttgagtgtttgtacacttagaatccaaagtccttagcatgatacacagagccccatctgatctccccacccctggtacctccctgatctcatctctcactgccctcccctcccctttaatgtactgtgagctttacaagtttctttttaaaaaaaacttacaagtttcttttaacttgtaaagctcactgtatattaaagacaatagccttttgtccatcaaatatgtaatcttttttttttttttttttttttgagacagagtcttgctctgtcgcccaggctggagtgcagtggtgtgatctcagctcactggaacctccgcctcccgggttcaagtgattctccttcccttcctcccgagtagctgggattacaggtgtgtgccaccatgcacagctaatttttgtatttttagtagagacggggttttgccatgttggccagactggtctcgaactcctgacctcagttgatctgcctgcctcagcctcccaaagtgctaggattacaggcgtgagccaccgtgccctgcctttttttttttcctccaatttattgcttttcgtctaacttggtggtgttttctgctgttcagaagtgatttttcattgagtggtcagttttattaatcctttgcttttactgtctctaccttttgtagtgtgcttagaaaggtcttgctcaccccagggttataataatactgttcacctacatcttcttctggtacttgtcatggtttgattttattctgtcatgtttaaattttaaggcacgcccctttttggtgataatagacaggtattgagtgcttatgatgtgtcaggctctgttccaggtgccttatgtgaatcagctcatttgaatgctcagtaagtccagagataggtctggtagatccttgttttcacaggtgaggaaacttgaagacagggtgattggatacttatgcaagaccacacagctggcgaaacctgttctgtcaaatgctaaaggctacatagggttgttgtaaggattagagttgttgtacgtaaagtctctggaatatagtaggcagtctatagatggtaggttttattaattattattacatagctcccataagcataatttctgacggctgcatattatttggaaaattgtgtatttcaaagtaagtacatttctaaaatattattcctttaaaagcatgtttagaattccatgggaacaaacaaaacttttatttgaagaaacaattgtcataaaaagaaatcccagaaagattgcattaacgtgtgtttcactgggcaatgggattttgtgtgtgtgtgtgtgtgtgtgttgtgtgtgtttaaatctttgttggcagagcagagcggctggccgctagaggtctctgatgcccgaggagctgtcagtggcgtgctggagagagcaagggatcactaacacctgagacggactacagaccagcacgtgccagaggtggaagtccaagttaaacgcaaaaggaccacctcctgagaaccaagaatgtcagttatacccgaggcttctcagcagcagcaagcacctgtggtgaatttccaggctgaactgagacaagcattcttaactgagacatcaagaagtggttaaagccgtattggaacagcaaggaatctgattccaaggaaaaaccagtcaatgtaataaagatgtaatctgtaatttttcaatgtgatgtagattcatttagtctgtctttttatgtttgctgctttcattttttaggaaaaggctattacaaggttgattttgatttattactttttttttttcctttgggatttttctttttttcgactttaagattagaatgctctcatttctgagggtttactatttactttttataaaataagagcagagaggaaggcggtttattgataaattctcttctagcttttctttatgtctttttgcaatattacccctcaacttgaattaattaggccaatttatgccaccattttgagtttaaatccaaggagacaaacaggaaatttctgagaaattctcctttgttgaatcatttatacccaacattttcagttttttttgtttgtttgtttgttttttgttttttttgttttgagacagggtctcactcagtcacccaggctggagtacagtggcttgatctcgactcacctcagcctccgcctcctgggttcaagtgattctcctgcctcagcctcccaagtagctgggattacaggtgcatgccaccatgcctagctaatttttgtacttttagtagatatggagttttgtcatgttgccgaggctggtattgaactcctgacctcaggtgatctgcctgccttggcctcccaaagtgctgggattacaggcgtgatccactgcacctggccagtatccaacattttctagtaattgcatgggcttggttgcaagcagatggtggaatctgatcattgtcccaagctcttccccaagagtaagacaatttttcattgaataggtgggtacgtttgattttttttaacctagaaattctttagcttatcagttcagttcacacattcttgtaaatttctaagtataatatttaaatcatacattatggtctgcaagtaggaccatttaattttctgatatttaattatatcctattttattctagtctcaactgctagttctacctaaacaatactagtttaggatttctttagagcagcggttggtaacatatctggcctgaaattttattggaacacaaccatgttcacttattacatgtgatctgtggttgcattggtgctacagtggcaactttgagtagttgtgactgatcgaatgacaggtacagcctagaatatttaatgtcttgccatttaaaagaaaaaaatggctgaactttgttttagagtagcagatttaaagaagaaaacaccagtgaggctaccgataacgttatagaaggtgatgaataaaggattatagacgtttatatgaagtatacattacagggtagagaatcagatgaattttttgggtaagggatgactcgaagaatcatgttaaaacttgctatataggtagatgggtagtttttaaagacatttaaacaattggtaccctttttcattatgaaaatataaggcacatgatagccaggaaaaatagataaataaaccattatgttatgaatatcagttcaatttttgtttggtacctaaaaatttactaggatatgcatcaaattggatacttacccaattgagatgcaaggtgtaaatattagtaatattagcatgacttttaaatgttttgttacattgttttctaaaagcatcactagaaatatggattgccactaaaaattaatagaccattagtttcttaggaccattctttttattctgttttttttttgttaaataaatatttccaataaaggaaaaaagttgtctatatttcagttttcataaaacagaatgtttaaacattttttctgatcagaaaagtagccacaaaaactgctatatttttaaaaggctgtgatgaaacaatgctgccactctggaaaacagtttggcagttctttaaacagttgaacatagaattaccatatgatccagcaattgctctcctaggtatatacccctaaaaatcgaaagcaaagactcaaacagattcttgtacaccagtgttcataacatgtatagtagccaaaatgtggaaacaacccaaatattatctatagaaagagtagataaacaaaacgtgctctgtacatataatggaatatgactcagccttaataaggagattctgatacagggcacaacgtagatgaaccttgaaaacattatgttaatcgaaataggccagacacgaacggacaaatgttgtatgatttcacttaaatgaggtaccaagaataggcaaattcatagagaaagtagaatagtagtgaccaagggctgggagaggggagaggggaagtgattaataggcttctgtttgggaaaatgaaacatttctggaaatagataatggtgatggttgcacaacattgggaatgtacttaatgccatagaattgtatgcttaaaaatggttaaaatggtaaattttatgtaatgtcctttttttttttttttttgagacagggtctcactctgttgcccagattggagtgcagtggcacgatctcagatcactgcaacctccgcctcccaggttcgagtgattctcctgcctcagccttctgagtagctgcaactacagacatgcaccaccattcctggctaattttgtagttttagtaaagatggggtttcaccatgttggtcaggctggtcttgaactcctgaccttaagtgatccacttgcctcggcctcccaaagtgctgggattacaggtatgagccactgctcctggctgtaatgtacatttttctatagtgaaacaacaatgggcaaggtgtggtggctcatgcctgtaatcccagcactttaggagaccaaggcagatggatcacctgaggtcaggagttcgagaccagcctggccaacattgtgaaaccctgtctctactaaaaatacaaaaattagcctgacatggtggcacacgcttgtaatcccagctactcaggaggctgaggcaggagaatcgcttgaacctgggaggtggaagttacagtgagctgagatcacgccactgggctccagcctgggtgatggagtgatactctgtctcaaaaaaatgaaaaattaaaaaaaaaacaacaacaacgataacaaaaggagccaaaattaccctctatctcatagactgctgggcttacgtgagataatttgcatgaagtgcttagcacagtgccaggatcatagggaatactcagtaaaggaaagataaatgtttttctaataatgtagaactatttaactatagaatgaccttctttgggggtggaatagtgagctccctgctactggaagcgtttaacagggggcagaacagacttcttaaagtttcatatgcaaagaaatcatctggacatagtgttaaaatggagattcttatttaaatagagtctggctgaggcctgagagtctacatttttagcaaggtccaggtgatattgatgttgccagttgagtgcacttgagtagcaggaggctagatgattccttagggggatgctggagaagctatgtgataattcatcagatggagcaatgagatagatctctgcggcctactgcgggagccactcaccacatgtggttattgagcatttgaaatgtggctagtccaaattgagatgtgctgtgaatgtaaaatacacaaaaatgtagtatggaatagactaaaatatttacttagtaatttttatattgattacatgctgaagtgatatttttggatgtattgggctaaacacaatattcagaatatatatacatatatatatatgtatatatatattatttttgagggggagtcttgctctgtcgcctgggctggagttcagtggcatgatcttggctcactgcaacctctgcctcccgggttcaagccattctcctgcctcagcctcccaagtagctgggattacaggcacccaccaccacacctggctaactttttttttaatttttagtagagatggattttcacaatgttggccaggctagtcttgaacaactaactcaagtgatctgcccgccttggccttccaaagttctgggattacaggcatgagccaaagaatattaatattgggatcgcttgagcccagaagtttgagaccagcctgggcaacatagggagacaccgtttctacaaaataaaaaataaaagcctagtcgagtatggtggtgcatggctatggtctcagccactcaggaggctgaggtagagacttactcggacccaggaggttgatgctgcagtgagccatgatagtgccattgctctccagcctgggtgacagagatagaccctgtctcaaaaaaaaaaaaaaaaacaacaatgtttaaagggctattaatggaaggagatcaagcagaatctagagggtgacacagggttagaagattttctttttgtggtaacctgggaagaatatgaagctgataggaaagataaatggagagggaaggtggctctccaggagcagcaaggaggagtgagtgaggtctgcaaggaggcataggtaagactaggttcatgcaatatttacataaacatataaaagatggaaaaatgttaatgctggtatctgggtagtggggatgacgcttacattttacttacttttgtgtgtgtgtgtgtgtgtgtgtgtgtactgtttgtttttttgagacggagtctcactctgttgcccagactggagtgcagtggttcgatcttggctcactgcaactgctgcctcccgagttcaagcggttttcctgcctcagcctcctgagtagctgggatcacaggcgtgtgccaccatgctcggctattttttgtatttttagtagagacggggtttcgccatgttggccaggctggtctcaaactcctgacctcaggcctgcctcagcttcccaaagtgctaggattaaaggtgtgagccactgcgcccaacctcttttgtgtttttatctttatttgtgtgtgtttaaaatttttcttttgtgttttcctttcccctccatgaagatgcatcactttaaaattgaggccaggcgggggagtattacttattatgaaaacaaaagcagaaaatctgcttcccgatgtaggaggaccataagttagggatagccagcccactgactccagcacacaaggacataaggccaccctccagaagcacatgacatgaacacacctatctcaagaattataggataagcatgtgtgtatgcatggtgaggactagaaggaggcttttgactatcaagagtagcagtggatgtttggatttcaggtaattgctaccttccttccacttttgtgtatagtttagtgatttataataactatgtattttttataatcagaaaaaatagtaaagctattgtaatgttgaaaactatatatagtcttcaccaaagaaattaatagtcccaatgtacactgcactgataaaatcacatcttaggctctcattctcctactggcccggaagaaccagtggccatattgtgagctgtctgtggaaagggtcacgttgcaggaaaacaggggcagcctcagcagctgagagtggcctctggacaacagccagaaagaaactgaagccctcagtgctacaggtgcaaggaaataaattctgcaacaatctgggtgagcgtggaagtggattttcactcagtcaagtcttaagataaaaatacaagtctggccgacaccttgattgcagccttgtgagatcccagagcacaggacccagtgaagtcatgcctggactcttgatctacagaaactgtgagacagtacatgtgtgttgttctaagctgctgaatttgtggcaaatttttaatgcagcatagaaaattaacacacactcctactagcagtatgtgagaatttgagatactttacatccttgccaatcctcagtccttttaactttggccacgctggtgggtgtgtattgtgattttaattttaattttcctgatgaataataatgttgaacactttttaatatgcttattggttattggatatactctcttatgaagtgccccgcaagcatttttcccattaaaaatttgagtagcctatcattttattactgttttaggagttctttacatatactggatatgaaattttgtaggatacatggattaaaaatctaccattgtggggcttgcgttttcactcttcttaatggtgacttcttttttctggggggtgggggggatggagtctcactcttgtcgcccaggctggagtgcagtggcgcaatctcggctcaatgcaacctccgcctcccaggttcaagcgattctcctgcctcagctttccgagtagctgggatcacaggcgtacgccaccacacctggttaatttttgtatatttagtagagacggggtttcaccatgttggccaggctgatctcgaactcatgacctcaggtgatccacccgtctcggcctcccaaagtgctgggattacaggcgtgagctcctgtgcccagccaaaaaaaatttgaggctggagcacagtggcgcgatcacagctcactgcagccttgacctcccggtctcaagtgattctcccacttcagcctccggagtaactgcgactacagtcgtggctaatttttaaatttttggtagaggcgggtgtttccttatattgcccaggctggtctcgacctcctgggctcaaatgatgttcctgcctcggcttcccaactatagtatagatgagagcaacatagcatagtggttaagagcaatcccagctctgccattttctaaattactctcctaaccttttatggcctgtgttctcaaccgtcaaaggggaaaaataatagtacctgtcttatagggtagttaggaacacaaaaagctcttggcatcacccttggtacatggtaggtactgcacaatgtcagctaatattatcgtcatgtgtgctgcctggagaaatttttaagtggaaaacaaaacaaacaaacaaaaacacaggccagacgaggtggctcacgcctttaatcccagcactttgaggggccaaggcgggtggatcacctgaggccaggagttggcgatcagcatggccaacatggcgaaaccccgtctctactaaaaatacaaaaattagctgggtgtggtagcaggcacctgtaatcccagctactcaggaggctgaggcaggagaatcgcttgaacctgggaggtggaggttgcagtgagccgagatcgcaccactgcactccagcctggaccacaaagtgagactctgtccaaaaaaaaacaaacaaaacccaacaaaataaaacaaggtgaactaaaatgagaaatatccttttggaagaacatagttccaaatatttattcattcaacaaataaccatttagggccaacttgcactgacttttccttataacacataagcaataaaccctattattgcgtactctcgcgtgattagggaacgttgttaagaggctcaaaaatcggacgtcatagctcaaaaatcggacgtcatagcacattggctaatggaatcacccaggggctttgcggtttccccttccagcagccagaggggccagagtcggaagctgggggtcggactcttggcatcttctggtggattatgaggtttggattaactgggatttcccgttggtgtttttctgcctcatctgtttagctttttgtggtcccctttttggtatccaacttgctctttcttaagtgaagtttctgattaaagcaagagcttcgagtaaggggtctgaccgtaatttttcactggttaatgtctgacgtccagtaggtgctgtctggatcattctccgtccctccctcccttctttccctcccccccttcctttctctccctttctcttttctttctctctctccctccctccttcctttctctttctctctctctctctttctctcctttcttggatggagtcttgctttgtcacccaggctagagggcagtggcgtgatctcagctcactgcaacctccacctccggggttcaagtgactctcctgcctcagcctcccgagtagctgggaccacaggtgcgtgccaccacacccagctaatttttttgcatttttactagagacgggatttcaccatgttggccaggctggtctcaaaactcctggcatcaagtgatgcgcccggaccctcaaagtgttgagattacaggcgtgagccaccgcgcctggccttgaactttattttctcattgagcccaggcacctcactaaattcggctcacccctatgtctcactttcctacttttgttttgaagcctttgccccaccccctccacgttgccgcctttttcgtactgagcgcgcagggcactacgcccaccactccccttgacccactcctcaagccctgataccggggcgaggccccttccttttctagtccttctacgcgccaggtgggtgggtttcgcggtgacgaggcgacacctctttcccctctggcgagcacgttaactggggaagctaccaaattctcacgccttagctgccctgcctccacctcccgcaagtccggttgcccctctaggcttctgcgcctgcagtggttccgaccctcgcctttagaactctgccgcttccgcctcttatttcgcgcctttgtttttagttttggaaggggcggagttgaaatggctgcgccgcggttgccgaagcaacgctttggttacttccgttggtttcaatgcttccgggttggcgctgcagtggcgtttccgactgtgggagcctcagcttcccagtcgtccgatgagcccgagcaggtgagggggagctcctggacttccaggctggggagcggggctgggccgcgccaggccgcgcggggccgggctggcctggttcccggcctgggaggggcttaacggtcctctggtctctctctcccctcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggagtaagcaaacacctccattgtattagtgtaagggatactgttgaaagatgctccccttcggtttctaccccctgtcactcctgaggtcaaggcattgaaggcatctattaaaatgcagttcagttacttgattggcatgacagctgttatcaacatgaattagtttctcagacaggataacagcagggacatttatggtttcctgtcagtgattccttgttgttgttgtttttccccccagcctagagatgcctagcgttatcatgaactcttccctcgtcttcattccctacatcatcgagttctttgtgtcttcattggggaagtctatctctaacctcagtgccaacaagcatctttgtctgctgtactttgcaccatcctaagctagtctccctgcctctcccgtttgtaatgtaatccactgtgtttgctgcagccctaataggctaaaatgtggtggatttcctcaagtcacttcgttgttaaacacacacacacaaaacatgcagccccctcctacaccccctacccccaccccttggtttcaagcctttcaacataacatgctccttatcacacttcttgtctgatactgtttcagtcaacaagggaattctctgttccagttaggttcctttcttcttggcacaaaccatactgatgcctgcttctacatgctgtgcttgttcccacatttgtgtttctgttcattctctcttccctgcccctctcccttacctgcacctaaccaggttgtacctaccgtctctcaaggttcaatttaggttctctcacctcggcaattttcaaattagtcaatcccatgctggttgtagtcttttctatgctcctcttgctcttaaagtttgtactacacagtttagtacttaatttttctctaacgcactactttgatttcttccaccagattataagctcttgaaaggcaagtactgtatttcgtacttttttctctgtcccatctcattggttattcagaaaagacaggttgagtggtaaatattgtcttggtgctagaacgaatatctgtgtttttcaaatatgattatacccaaagtgcattgcaggtttgggcatttagcatgccttcaataaatatctgcttggctctccattgttaccttctgaatctgagaatctctaatttctactctttcttaaaggagaaagcaggagaggcacccagagtttcctgaccagatcttgggagtagtatagggcaatgtaacttgtattgtaggacattcttactttcactcattagtctatcaaattctccgaagtcagatcttcagaataaatgttggcattttgaagacaattttcattggtttctttatacagtaaaaatatttagggtactatatttttattttaccttagatatgactacttttacgcatatttggggttagcccctacaagttaaaataatttttagagggcttggggtattttacataagtaattccttggaacaaaagcaagggaacagggttcgcaggcagagaatatctggggatcaagatagtgtcatacacagggtgtgtagcattggccaggtccagcaagttaccttccttgtttcctctgcaatcttttatatacaggctgcatacataggtaaaggatgtcacactgcaaaaccaactaagtattgaatggatatgtattcaattctatgcaagctataatgggggttataaaaagtactgtgagatatagtatcttcccttggggatcttacttagttaagagaggaaataacattggacatcttgaagttgaccctcatcctagtcattatttttatgcctgagattaagatatagaagggataaaagaaggttcaaaaaatattgcacacctgtagaataggtgtgacacaacacgcatgcatgtagacaactttatgtaaaagacttggaggtttcagctgacagtttaatgatttgatagtgtgatgtggctcccaaaaaagtgagtgcaattttaagctctagtaattgaagtataatgtgtcaaatgaagagaaagatcatggatatttagctcaagaaacatgagatgtaagagaacatcatagctgtctttaaatatttgaagggcttgcctagggaaaaaagaatgcatttgttgaatattacctccaaagactgggtacaaattagaggaagacagacttttggctcaatatgaggagggagtgtctaaaaacagatctaatcaaatatgatccaggatttcttcataagattttttcctaacattggagtgaaagagattttactatcagatgggggtagggaagtcgtgattgtggcaatggtgggttttgcctgtggtctccagatttttggatttcatgggccagtaaaatgtaaatgaaaatgtgggaagggtacacaaatacaggctagttagcctgtgctccaggcgtaagaagaatctgatctgttaataatagacagtccctaaattaaatacatttagctgaaaaaaaaaaaaaggactaagtgtccttatttttttcatttcgccccagaattgtgggaacttcattagggaaccactgggctaactggcctaagattcagcgactggtctttcatcttcctgccatgtcctccctgttccttgcctttcactgattcatcattgctccctgagcacattttccttattaaagggctggtagcagcttgtgaagttccgatagaggctttctctgtaatacaaagagttgaaaaaagttgtaaggagaaaaagttttggagagacaactttaagtaaaagtagctgtctgaaacctttaagactatttggggcaatcgataaatttgtgaatggagagttaattttttcctcacaaactcaaagaggggatatgccatggtcttgcttttccatctctactctcaccatatgtgtcatattttactatcaattctaattggaaaatgtgggcatagctagaaatggtgataaggtagtatttagtcttcaagactcctatttccagctgcagttgatacttgaagtggctattcctactttgctcattagaattcttttcaacaactttccctcaaaagggctatctatcccagactctatatgtgctatgcttgaaaggaagcctccataatgatttttgtggcctgtaactaaaacatttaatcagcgtgtttgctatcttctctggaaaattgtattttgcttagttacagagaattccttatgtggaaacaaagcaaaaccttcaaagggatactgtgactcatagctgctaaccccagactgggcaatgggagggaggggtgggcagcaagtaatatctgttaagatgtaaatttgggtacttaaatttttaaaaatgtaataatgatagttaactaacaattattgagctacatgccaggcacttttaaaggtgtttttcatatattatttaattttcacaacaaccctatgatatagtttttattattagttccattttacagttcagaaagtggaggcatagagagattaacttgcccaaggtcacagaactagtaagtggtggagtcaggaaatgaatctggagttagcatttaaattttaacagtctgacttcaggagtctgcattcctcaccataaaccacttggaagttgcttttgaaattcagaagtatacatactgtgaagctctgaaaaaggaatatttgaaagaaatctgagagtccatgctaagaacagatactactttcagatggaccaggatttagtaggcaatgcctagagcagttcttaagtgtggaagtatcagcgttatttgggatcttgcaaattctcagggccataccaccaatcagaaactctgggggagaggcccaacaatctatgttttaatagaccttctagatgattctaatacatgctaaaatttgcaaaacctagaggccagagctctggaaaaaataaaatccaagagagagcaagctgacagtggcagaaaaagagagtaaagctgaaaagattgatgatgacaggtctaacgggggtgggatagggaaggagaaaagggaggctgggagcagaatacgttgttaaagaactagaacataaaagaagaacagtatttatatgtgtgtgttttaaaaggccaagaggaaggaaaaggagatccactagatggatgtacgttaaatgtcagagggaagatagacatcatattgctatcattcctttgggcgctagaaggaaggtgaaaaagttcttagctcagcctgggcctagttggggggacaaagttatatatagctagataccctatagtagagagataggagggctaagaatatgagagagtagtagtgtgagcctgtgctttgcacctgaatcaagctaactgaataccatgaactgcttttatgagatgcctcagcctatataatttgaattccgggttccttcatttgtaattatctagttgaatgtcaaagttgggtgtgctggatggactgaagcctcttctctgggtggggatgaatataacattaaagaaactggagagaatgaagggcacaggttgatctctgagtgaatcacacgcctacccctacaaaatgtcagtaaagaacaaactcatgatcatccagcacataaaacaggatcccccatttttgtgtcattccacttggtggggtttttcttctacatctattttatttgccaattttgtttatctaaattatatgatcagatgctaacaaatgctcctcactcttgtgccttgttctgatttgtgtttatttttagcaccagaaaagtaccactgtaagtcatgagatgtctggtctgaattggaaaccctttgtatatggcggccttgcctctatcgtggctgagtttggtaagaatgtgagaaatgacaaatctgcattatacggtatagatggtagcttatgatgatggttatttttggtgaaagctaggtaaaaaataagaagctcgccttattttgaaaattgtctcaaagccatgaagtaatatttcagggaaagtactactgatggtatggcagatgagttaagaaaagtcaaactaaggaaagcttttttggtagtttagtgatttgttagtttgctaggcttaagtaaaatacatgaatatatagagggagttgatatgtcataagggtttttgctatatttctgtattaatagtcttttatgctaaattatttataagtttatttgtactgaaagtcctttttttcaaacctctttcccattttagaagaaaatgtactaacaagatcaaacaagattctcttctacatgattttgattttgaaatatttttagattgtcgtttttttcatcttccagatgttctcttttctaaactattcatgagtgactactgacgttcttggcatatcctgtggtgttgtgatatttgggtcatcagtgaccagagctacctaatcaccttgttagttttacaccctgaaatatattttgtcaatgtgatgaccacttctgtttgttgatgtaagaggtttggttaaagaaatttcccccccaaacactctgctggtattagtcctgaattacctaagggaccaggatgagtagaaccaaataagactttgccattatctttcataatattaggggactatttgtttcttgtaaacagataaaagaaaaaccccacaaaactttgtaacactatataagagcatctggagcagcaatcccatgctttcctatctttgtgaaaatttagggagattttatgagacacagaggtggggagacttggggtgggaaggggcaggagggagactgataaatgccagattatatgttacagatgaaataaaaaacaacatttaattattttgcatttataatagggcaatctgaaagcattttattatattacagtttgaagtatattgtgggtcaattggtgctgcctatgtatagtataatgcatttcacttaccacatgcaactcatgttctctgacagtggtattctactagagctcttctatgtgttataaaaaggactttgtcttaggattcaaatattgtccttggcttatatttagcaacaacttaactgtgattctttggacatacttataaataagtgtgttcctttatagggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcagggtgagactggttctttccttatatcattaacagaaatgctttttaaagaagccatagttttcagctgtctgatagtttgtgtccgtttcatattcaccatttcaacttgtaattcagtattgatatgccagtttatatttctcctgcttgtaagtcttgagctttggattttgtgttcatttggttataagtgataataacattttaaaatggatatgtcattgcagcataggctttctgtggatttcccgagagtcactaatagccactgttaataacagcaccaattaattatatatatttttgtgatatccctcctgagttggcaaattctgacttcctttaaaattttcctctttgaaaaaatattattcttgcagtttaaacagaaagtgcataatgagagagagggagacccatctttatcatcaccttttgattagccataattttgtggtttactgtctagtttgtagtttatctgttgccagtttcctaggccactcctgcatctaggctaccagtttattactcagagaatagacatcaattttattgttaaactatgttacatcgttaaactatgttagacttaatttaaaaggtaattttcttgggggaaaaatcaagtagtgtatcctgaagcatcctgaagatgatccaccatcctgatttgtggatcatctgtttcaccttgttctttcatcagcatagatcatcacaagatattttctgatagcaagcaataaagtcagaaatatgcatatttagtcatcatttaaaaatcctaaccatttgagctgctgctgtctttctatttatacctcctacagtatagttctgcaatttggaagaatcccaaaggaggtatgaatgagaatgtctccagtttaaaggagaacttaaatagggtggaattttggctctagtacctccttgttgatgtgattaaagacgtatctgcaactgttaggaagtagaggttgatttttttaaaaaaatctttattaggtgagcaatgatgtataattctttttatacattgctggattcaatttaccaatattttcttaaggagttttgcatctaagttcatgagagacattagtctgtggttttccttttttgtactgtttttgtctggttttggtatcagggtaatactagccaaaattagttgggaagcattccctcttctgttttctggaaggaactgtgtaagcttagtgttaatttttaaaatgttttgtagaattccccagtgaaattatctggggctatttctttttggggaacatttaaattcagagtgcaaattctttaaggttatcatagtttggggtgctataacaaaataccatagactgggtgacttataaacaatcggaatttatttctcacagttctggaggcaggaaatctgagatcggtgccagtttggtcaggttctgctgaggtctcttttctgggttgcagactgccaagacttcttattgtatcctcacatggcagacagagtgagggagctctctgggatcccttttataagggcactaatcctgttcatgagggctttaccctcatgacctaatcacctcctattaccatcatattgcgggttaggattttaagatcttgatttggggacgatacaaacattcagtccattgcaatgggtatgagttttattcagattatttgttttatctagttgagttttggtagcttctggttttcaaggaatttgtccatttcttctaaggtgttgaatttatgagtataaagttgtttataccatactcttattgtccttttaatggctgcaggaattgtagtgctagtccctgtttcatttcttatttgcatcttctgtctttttatctttgtgagtcttgctagaggtttatcaattttgttgatttttttttaaagagctaactttttgtttcattgatttttctctattttcctattttcaatttcattgatttgtgctttttattattttcttttgcttgctttgggttattttgcttttctttttctagtttcttgaggtaggagcatagattattgatttgagactctacccccccccccccttttttttttttaaaatgcaagcatttcatgctgtaaatttccctcagcactgctttggctgcatctcatacattttaataggttgaattttgttgtcatttagacctgtgaattaaaaaaaaattcctttgacagacacttggtctgaccaatagattatttagatatatattgtttaatttctaaatgtttgaggatttttcttattgatttctggtttgattccattattgtcagataacatattgtatatgatttcagttcttttaaatttgttgaggttggttttatgacccagaatgttcagtttcttgctgagtgtttcatgagtgcttgaaaaaaatcatattctgctgttgttgggtagaatgagatgggtagtccaaataagtaggctatctagatatgtataatctgaaaatgttgagaataactttttacttttttttttttcagaattgctcctgcgttgctaagacaagcatcatatggcaccattaaaattgggatttaccaaagcttgaagcgcttattcgtagaacgtttagaaggtcagtatacttaccctcttttgaggtgatactcaaagggattgttgaaatcatgcttagtgagaaatgttggtcatgaggtgcctgagaatggaggagagtcactgcaaagacaaagtgagcttgttctaacttggaataaatctttgcagaggtgatatatgaattagagagacctgttcttcaaatttgtcccttttcctatcaacaaaaaaggcatgtgatcatcccaaaagaaacatggaacaatcttgtccagaaaattaatgctatcttcatcaataagaggacttcaactgtaaggcattttctagctggcaattttgataagcttttattaggcagaataattttaggctgttttctaaattctgatgtacctttggctaccttatgcatattcagcattatcatatgtctgtttgctgctgtagcattttccatcatgatactacactaaatggttattttaccacaggcctggggctgttggatgtttggggacagctggaaagcctttcggttagtaatgtcctttgaatcactttattgtcctaaagtcaactttttctgaagcctttttttggggattgtgaagggttctcttccacctctttctgaaatatttttctttcatagattcttcacttgggtttatttagtttctatttgtggggtcttcatggtgtgaaggagcggtaaagattgaatttcactatagaacaatgtgctctgtggtttctttgttcttttttctcactgaggagatttagttctaaatgattgctttttcatatttgactacagaaatattttataaattaacagaggctaggagagatctcaggcctatcaaaattaatattcaaataagttttttgtattagacgtaagattttctcttttaacattcagttcctgaatctttagagttgatgattacccagaaaaagacttaaaaagtatgttctttagatgtttgaaaaggtcgaaggggaaataccaccttctgaatttgtgtgtgggatactgatagttatgtagaagaaaaggacgtgttccagtgtcctttagaaataatgatgtttttagaaatgatttatattttacaagttttaatatattttagcactgaattgagatctagaaatatttgagtttctttattttcctaagctttttggttcatttctaaagtcatctctctaaccaagtttcccttcctccagtaggtcagtagtatgtactcaaactggtgcctaatacaagcagacctttctttttcttttccttttcacagatgaaactcttttaattaatatgatctgtggggtagtgtcaggagtgatatcttccactatagccaatcccaccgatgttctaaaggtaagagagatacagtgtgatttgaaaggagcataactttgagtcagatttgggttcagattcccactctgtcacttgccagctgtagaaccttgggcaaatcagttaactgcattaagcctcaatttcatcatttgaaaaatgaatataatacagtgtttataacatagagttgtaaaggattagcgataatatatatataaactgcctatcattgtacttggtgtagtagatgctcaataaatggcagtcagtttattatgatatgtgttaatccactggtcctcacactggggtatgcaagaccctataggttctttccaagggctatgcagttttataggaatcaatttccagatctcttacatccatttgtactccatcctaaaactggtacgagaatgaatctgttcataatagcccttactcaattttacaaaagaaatgtacgtccccacctattctaaatcttggtatggtatgttgacctgtggtataacctgggatgccaaacagaggggtaaactgaaatacagttcttggagaagcctattttagtaaccaatttgggtatcttaagtctgtaatgcctctgtctttccctgtcttattaatatttctattcagggtgagatttggctttaaacatggtatattttggcctgtattggaatattctgaattcagaaccagaatagtataggttggtggtgctgacttgttaagagtatagttggatttctttaaggttttttcaagtcacagactgaaacatttcttttaatataaattttcatcttatttcataaaatggtaaatattttctacttattaacgtatttaagcttatgattagttaaaagcactaaatataggattaaaataagtgaggggaacccaaagttttaacaaattattttaaggggattgcgagaaaaaagtaagaggacacatgcttttttaaatttgaccactagtgaaaccacaagtggctaggttagcaaaggagagatctatttattgcaattcagagaggggtttgagaacagagagaaagacatgaaaaacaacacacatgaaataaaccactggtggttgatggataaaaatatgagacagtctttctggactaaaatgatagtaatttacagaatttttatatcattttaggtttacagaacaagtttttttttcaccgtttattttagattcagggagtacatgtgcaggtttattacatgggtatattgtatgatgctcaggtttgggatatgaatgatcccatcacccagatagtgagcacagtacccaacagtttttcaacccttgtccccctccttctctcctgcctctattattccctggtgtctattgttgccatctttgtccatgagtatgcaatatttagctcccacttataagtgagaacatgctatctttggttttctgttcctgcattaattcatttaggataatggcctctggctcaatccatgttactgcaaaggacatgattttgttcttttttatgactgcatagtattccatggtgtatatgtaccacattttctttatccagtccaacggtggtgggcacctaggttgattccatgtctttgctattgtgaatagtgctgtgatgaacataggagtgtatgtgtctttttggtagaattatttattttcttttggatatatactcagtaatgggattgctgggttgaatggtagctctctgttttaagttccttgagaagtctccaaactgctttccaaagtggctgaactaatttacattcccaccaatggtgtctaagcattcccttttctctgcagcctcgccagcatctgttgtttttactttttaataataaccattctgactggtgtgagatggtatcttgttgtggtttgatttacatttctctgatgattagtgatattgtgcatctttttatgtttgttggctgcttgtatgtcttcttttgagaagtgtccgttcatgtcttttgcctactttttaatggagttatttggtttttgcttgttgaattaaattccttatagatgctggataccagattttcatcagatgcatagtttgtgaatattttctcccattctataggttgtttctttactctgttggtagtttcttttgttggaagaagatttttagtttaatcaggtcccgcttgtcaattttttgttttgttgcaattgcttttgatgacttagtcataaattatttcccaaggccaatgcccagaatggcgtttcctaggttttcttttaggattcttaaaatttgaggtcttacatttaaatctttaatctgtcttgagttaatttttgtatatggtgaaaggtaggggcccagttttattcttctgcatatagctagtcagctgtcccagtaccatttattgaatagggagtcctttccccatgcttatttttgttgacttagaacaggtatttatgaagagaatttaattgaagagctccttgtacctcttactctaagcagacaaccccacctcctatggcctggccttatacctctcaatttcgtgtcctttctaccttacaggtgtaaacttacttccatctatacccatccttatcttgtcttactgtagtggttttccagaccagaccagtattacctgggaacttgttagaaatgcaaattatcaggccccatccaacacctactgaaccagaaagggtaggatggggcccagcagtctggtttgacaagcccttcaagtgattttgatacatgctcaagtttaaaaaaaacctggttactctacttttattcacttctgtttcatcagagacctttatcatttgtcctctttctcttattttcagtgtcttcctctttaccggttatcttctctcaaatgataaatatggtcaaatctctctatcctaaaatattttcttgaccctctgacctcaaaacaccatgctatctcttttcttaccttctcatccagattttacaagagtaatctttacattccatttccttcataacctgctgtaatcactcctgctacttgattgaaatcactctccacagggtcagcagtaatgtcctcattatccaatccagtggacattttagttctcatcttacttaacctattttgactaattccttctactagaagttcttttttggttttgttactacactatttagattctgcttctagttttcctattccttagcttcattcatgggcttcctttttatgcatatactttaaatctttttcttctcccacccaaggttccatctttagctcttttctcctcttcagtctctccttgatggcctttttcattctttttttttttttttactattattattattttttttgagacggagtctcgctctgtctcccaggctggagtgcagtggcgcgatctcggctcactgcaagctccgcctcccgggttcacgccattctcctgcctcagcctcctgagtagctgggactacaggcgcccgccaccacacctggctaattttttgtacttttagtagagacggggtttcaccgtgttagccaggatggtgtcgatttcctgacctcgtgatccacccgccttggcctcccaaagtgctgggattacaggcgtgagccaccgtgcccgaccgcctttttcattcttaatactttagctctcactatatcagttaggttatgggctaagctactgtcacaaagaaactcaaaaataaaaggtctccatatacaagtatttatctctctcatgtaaccatctagaggactgcagttaatgctggtaaggcagaactacttcatgtagtcatccaggatccaggtttcttcatttttgttgcactgccatctcctagggcagggattggcaaactactgtctgtgggtcaaatctggcccaccccctgttgtgaataaagttttattggaacacagccaccccatttttttatttattgtctataattgcttttgtgcttcagtgacagagttgagtagtcacaacagaggtcataagccctgcaaagcctaatatatttactgtctggacccttacagaaaacgtttgttgacccctgtcctatggtattattttagtctgtatagttgaagttggaccactatcaaacctacattccagcccatgggaagagagtcaagggaaagcagtttccttttgatttgtcaaaaataaagtcaggaaaaattttaaagtttattgtatgcaataagagaaagtacgggtctcgatccaggatacttcaaaccaaatgataacaaacttatcttacagtacagtttataaagcagaagggcagaaacattttgaccttttttgtgattggctgttataaattatcgttcttttaaaggcaagcagctgtttaaggtgattgtctatagttattggtttcatttcactgaagcattctgacaaagatgtaaagcttatgttttgtgtttatgattagagatagcagttccgaggaaataggatgacttaaggttcggttacctgatgatgggtggctggtcttggggtttatctcaattgttgcctccatttttatctttaacagtttaaatctttaaatatgtagttttggagaaacaatttcaaacatatgagtgagtagaaaataacatagtacagtgaacgtctttgtacacatcacggaggtagctaagattttgctacatgtgcttttttattccctttttctgaattattttaaggcacattccagacattgtcattttcccccatatacttcgatgtgcatctcataaaaggaatatttttctatataaccatggtgctattgttacatttaacaaaattaacatttattcattagtaacatctaataatctatgttcacatttccagactgtcttatattttacagttgatttgtttaacttgggttccaaagcctatgcattatatttaatagttatgtttcttaagtcctttttattctagagtaccccactcctgtccatataccttttatttatttatttatttatttgctttttgccattaacttgtcaaataaatgggatcagctctcctttagaattcccaagttttggatttgtctttttgcttccttgtgatatcatttaacttatttctctaaatcttctctctctgtaaaagggaaggtttctgtaaaggtcataccgagtcatgtgaggaggcacacagtgtttggttgtcccaatatagggatgttaaggttgatcagtgggttcaggcgtgacagcccgatttctcctttgtagtttcctgtcaatccttcatctaatggtttcatccattggtggccattacctgaattgattgtttcatttaaggtcgcaaagtggtgattttctaattccatcattccatccatgtttcttagctagaattcttctgcaagggcaatctttttttttttttttttttttttttttgagatggagtctcgctctgttgcccaggctggagtgcaatggcatgatctcggctcactgcaacctccacttcctgggttcaagcaattctcctgcctcagcctctcgagtagctgggattacacaggtgcacaccaccacgcctggctaatttttgtatttttagtagagacggggtttcgccatgttggccaggctggtttcaaactactgacctcaggtgatccgcccacctcggcctcccaaagtgctgggattacaggcgtgagccactgcgcctggccaaggacaactttttctcatttagtggggctgtttggctgttctgaaatataggcaatttccttttaagcaagacactgggaagtttcaaccattatttctgttcacgttccattctgaaggacttggttccatggctacatctagcttcaagaaaggagagtagattttgggagacaataatctaccacactacccagacctactgggtcatctaaactagaaacctagatcatctttgattcttctatatctttgcttccttctagtattggattaggtatcaagtttctacagattttgcctcatctgtatttctcaactttgtcctttccccaccattccttttgtaggacctcatctcagtagcctcctaacttgtcccttcactctagtgtgtaccccactccctcaacccatctccagatgaagctggagagatctatcgaaatccatatctgatctactatgtactgcttctttgcctttgtgcacgtaacactttcttcctgaaacgtctttctcattttcctggtgaatttgtccttcaagaccaggctcataaacagggccaggactagggcaaaacaagtaaggcagtcccctttgatgcagaatgtaagaaggtgccacaaaactcagtaatcaatataaacaacatttgtatgtagtatttttaaacaatcaaaattaacgcaaaaaattcatgatgaaccaaataccaaaatttcacataactcatctcattcaccttaccctaatcctggccctgttgagtcctagctttagttaaatttgatatttgattcattatggctttttgtggattaattttggttaaaaaatatcatattgagacatcatttatcttgattactgagtttttcttgcactcccttacatttcatgcctaagaaaagtacttcacttgcctcacgctagcccctctgttgtcaggaatcacctccttaaagaagtgttctacttaccacagtgtattagtagttttcatttgtctttgtgataggttgtatcttgatttaatgggtttaggtttttataattataatatttgaaaactcttagtagtaacagttaactttctgcataaaagcatgttgccattacatgacttactaaagacatttgttgaaacctagaatggtagcatggtgcttcataaaaatcaggcctacatttgggccgctagtatttagtgactgactactaggattgtatgtgtgcagagtctgtgggaaattgtaccaaaccttttacatggccatttaatgctatctttccttcttgcagctctcaaaggccacttggcagaatataatattatgctttttataaatagaactcaacttaaggtctcataaacataaaattatattttaaaacacatttttcatttttataattacgtaagcaatgcatgtttaatgtagaaaaatatggaaggcagaaaaaacacaaaagagaaaaatgcttacttgtagcctcaccactcagacataaaccactgtaagtatttagttttatatgttcacctcgtctctttgctgtgcttatggatatttttaagtttacatgttttttataaaaatgatatagtacttcgcaattttttttctggttagcaattaatttttgatatctttcagtgtcagcaaataccattgtacaacaaaattttatggctccatagtattctattaaatgaatgtataatttctgtaaccaacctgtgtagttgtttttggatattaagttgtttctaatttttcactaaatgagtcattttttagtcctgctgagtacttgatctttcttttctccaaattttcttctagctccagaaataatagacttagtgtgaggaatgtgaggccgatgaaaaccatttttataaaatacactttgacacaaattctttttctatacagtttaactaattaactttatcataatagcagatatttttctgggattcctgaatacttctttttaaattttagatgaatttaaaatgaatttaaatgaacttaaaatgaatttagcattttggttctctctgacaaaataagatgttcacctcttttcattttagattcgaatgcaggctcaaggaagcttgttccaagggagcatgattggaagctttatcgatatataccaacaagaaggcaccaggggtctgtggagggtaagtactcttttcctgctattatcctacactctcagttcctacaatttgcagagaatttttttttatataaagacataaaatcgtgaattataatccaaaaactaaggtaagaaactcctcatctcccttgaaaggcccaaaacttatcattggccttttatttctgcataatgtttggggattatataggtggggaaagttattacattatttgagatggctgtttcgatcatattcacagtgaatgtagttgttcagtgtatttttttgcaagttctgtactaacacgatgatgtatgtctttgtagtgcttatgttcaaaagctgttaccggctgtgtgctgtggctcatgcctgtaatcccagcactttgggaggccaacgcgggtggatcacttgaggtcagaagttcaagaccagcctggccaacctggtgaaaccccatctcaactagaaatacaaaaattagccaggcatggtggtgcatggctgtagtcacagctactcaggaggctgaggcaggagaattgtttgaaccctggaggtggaggttgcagtgagccaagatcatgccactgcactccagcctaggtgacagggcgagactctgtctcaaaaaaaaaaaaaaaaaaaaaaagaataagaaaaaaaagctgttaccttaaacaattttttaacctaaaaagtctaacatgtactgtaaaatattgagaaaatatagaaaagtaaaaagaaaaaaaatccagtagtcccactgcctagagataatttctgttaaactttttgtcatattatctttcagtcttctatctatactttgcttttcgtcattgttgctctaactttttaatccctaattattgtaatattaataatattattagtagaatatacagagagagtggaatgggaaatctattaatagacttttaaataaaaatgagagctttggtatttttctttataatttttcataacaaaaatttcaagcataaagaaaaattgaaagaatagaactatgaaatacatacctatgagctggatttgatggctgttaaagtttgatcgtatttgctttatctgtttacgtgtatacagacatacactctttttagctaagctaaatgaaagtaggttgcagacatcatggcactcaattaaattcttcattgtgcatctcctaagaataaggatagtcttctacataataataataccattatcatatctaagaaaatgaacaagtccctaatacctaatatctagcccatattagaatttcctgttaatgagaccaggctaatttataatttattttcttccttcctccttttttttttttctttttttttttgacagggtctcactttgttgcctaggctggtcttgatcttctggcttcaagtgatcctctggccttggccttacagatgtgagccaccatgcctggccaggctagttttcttataaagtgtttcctcattgtgtttgtttctctatctttatagagaaaatatctttatatttacagtttatttcctataaactgtaaatagggtccattggcttgattagattcatgttaaacatttttggtaagggtgcttcataggtgatgctgtgtatttcatactgcatcacagcaggaggcacataatattagtttgtcccatgattagtggtgccaagtttgattatttggtaagatgacgtccaccagatctcgccattgtaaaacataagttttttccccctcctttgcaattagcaagtaatctgtggggtgataatattctagtaatatgcatatatcctaatatctaatcacctttcatctaactaatggtctttgcatccattaatggtccttgaggtttgctttttggtaacagcagggtacacttgcttgatatgtctaatttaaagccagaaaatagaactaactagaactttctcacaaactgatgacaaggaacaaaaacagaggaataaatagaattggagattttttcacaggagcatagctactttattttttattgtagtaaaaagtagacataacataaaatttaccatcttaaccatttttgatggttcagtagtgttaattaagtacattcacattgttgtacaactgatctccagaactctttaggtcttatcaaactgaaactctatacccatgaagcaactccccatttctccttcccctagcccctggcaacccccattctcttttgtgtctctatcaatttgactattataggtacttcatgtaagtggaatcacacaatatttatctttttgtgactggctgattttacttagcatgatgttctcaaggttcatccatgtggtagcatgtgtcagaatttcttcctttttaaggctgaataatattccattgtatgtatataccacattttgtttatccattcaaccattgatggacatttgaatggcttctgccttttgcctattgtgaataatgctgctgggtaaatgggtgtgcaaatatcttttttagaccctgctttcaattcttttggttatatagccgaaagtggaattgctggattatgtggtaaatctatgtttattttttgagaaactgaacataactgtttttatgatccaggctacttacatgatctaggcacctaacataaagaagcaaagtacattgttgaatgtattcttctgagacagacatgttttatttgcatgttaaaaatacaggacttactttttcatttcaacaagaaaatatgtttgcatttttcttcaaacgtgctcatctttgtttatcttcctgctctgattgtaacatgaatactgaaaacatttcactttcttcctaacttcattgtaagaaaaaatagcacgagcacaataacaaagtataactagcacttaccacagagttggagagagagtagcatggtggggactgtggtcctggagagcacggagagcacagtccccgttgagagaggacagctactccttagctccagcccattgctgccatgcgttgatggtgagcccggtgtggtcaaattttctggcctttcaagagaagctggaaatctgcatttctgtgtgaaatatcctgatttttacatattaacagccaattcagtcttttggaaacactgtgggccactcgaaacatgcctatagcctgattttggcctgtgggctccagtttggggccttactgttcaccaaagcagtcttctgtgaagggtaccctctttatgagaagcaggtcaaagagccagcaaggaaggcacccttcggctagccagccatatcagcacaatcaaacatcttggcatagctgtgtcacttccacttcattttatttatttatttatttatttatttatttatttatttatttatttattttttgagacggagtcttgctatgttgccaggctggagtgcagtggcgcgatctcggctcactgcaacctccgcctcctgggttcaagcgattctcctgcctcagcctcctgtgtagctgggattattattattatttttttaagtgaaagcaagtttattaagtaaaggaataaagaatggctactccataggcagagcagccccactttataaattgagtttgggaacttagagatgactgaaaactttttaatatagtggttatcccagaaagcagatgtcctcatggtatgttattttcaattttaactgacacctaaacacagttataaaagtaaaacattcattgtgaaaatgtaaaaagaaataggcataaaaatgaaaattaacatctcttatcctaataccagaggaaaaaaatattttgatgtatttcgttctaatcctaagaatttggcctggtgtgtataccttttcccctgaagatagaataatactatatataattttatgccttgctttatttaacatgctatcatgctatcataagcgttttcttgtgtcattaatattcttcaaaaatgtgacttttaatgctctagcaaccctgtgttgtaatgtgagctgtgataggagcatcgtgctagtgagtgaaaccctggtaatgttaccacagcaggacttgtaagcgaaggaccactttcccttggcttttcctcttgcttcttcatacctttgctgtcaccttagtgtttgtcctttctgcacatctgaaaattctgtgaattaaacctgaaagctctcttctccccactgatttttgcttcatgattttatttataacagctttattgggaaaattcacatattataatgataattcccaaattctttattgagataattcacataaaattcaccatctttaaagtatacgatttaattgtttctagtatattcacagattagtgcagccattaccactgtctaagtttagaacattttcattaccaaaaagaaacccttaccctttacccatcacttctcatttcccccagccctcctagctgtggacaaccactaatctactttctgtctctatagatttacctgttctaggtatttcatgtaaatggaatcacgcaatatgtagactttcgtgactggcttcttccatttagcatactgattttaaggtttatccatgttgcagcatgtatcagtactttattcctttttatgggtgaatattaattccattgtgtgggtataccacattgtatttgtcccttcatcaattaatgagcatttgggttctttgcacattttggctattatgaatactgctatgaacatttctgtacacatttttgtatgaacatctattttcagttctcttgggtatatacctaggtgtagaattgctcgctcatatggtaatctgtgtttaactttttgaggaagtgccaaattgttttccacagtggctgccccattttacattcccactgacagcatataagggttcctatttcttcacatcctcaccaacacttgctcttttactttttctttcttaatttttttaaatttttttttgaggcaggatcttgctgtgttgcccaagctggaatgcagtggtgcaatcatggctcactgcagcctcagcctcccaggctcgggtgatcctcccacctcagcatctcaagtagctgggactacaggcacatgccaccatgcctggctaatttaaaaaatttttttaagagatagagtcttactgtattgcccaggtttgtctagaactcctcctcaagtgatcctcctgcctcaccctctcaaagtgctgggattacaggcatgagcccctgtgcctggccttcttttacttaaaagaaaaatcgttatagccatcctagtaggtatgaagtggtatgtccttgtggttttgatttgcatttctctagtgactaatgatgtttagcatcttttcgtgtgcttattggccatttgtgtatcttttttgaaggaaatatcttcaggtcttttggccattttaaaattggattgtttgccttttttgttgtaagagttatttatatattcttgacactagtcccttatcagatatatgagcggcaaatgtttttttcctttgtgtatgttgactcttcactttctgagtggtgtcttttgagtcataaaagtttttaattgtgatgaagtccagttgatcttttttttttcttttgtcttttgtgctttgggtgtcatatcaattattttatttttagtatagcaagtgaattggaaatttgtatatgttccattattagtcattgatttgaaagagtgacgtctgtacttcagacttgtatttttctgttacttttcaactcctgacctattttgttcactctaagacatcactccctttgtatttccttggtgcctaatgtcacttgtgtttcgtagggtgtggttccaactgctcagcgtgctgccatcgttgtaggagtagagctaccagtctatgatattactaagaagcatttaatattgtcaggaatgatgggcgatacaattttaactcacttcgtgtaagtaggatgggatgtgctcattttatttccagcattttgagcacaaaaagcctcttttactgaaatcctcaggtggaatttgataactggtacgtatggcctaaattcccttgtctctcctattatcagaacttcaagccttatgaacactttatacttcacagaaatgccaggtgctatgggggcttgggtacttgggaacattgtctaatacagcagcctatcagaggtctatttgatttacatttatccatacatagcttctatatctaataagcacatctattatttgctttggttaattttgtttgagaaagcaaacttttctcagtgggaatcagaaaaaaaggggtaaataaggtctgtgaaactaaagcacagttttttggctaaagactgttactgatctcattttacattttctttgtcttgcaacctttatgataattttgttactcaaatgcatttggcatgtgatgctgtggtttgaaaaatttatgtaactaatacatggtgcatgatactttctacttaggaatcttgttaggtttagaaactctcctttaaaaaaaaggctgagtttcagattgaaaattgaagggacagcctttgaatgatgtctctttagaaaaatttcctgtctctttagattgtaacgaaaggccaagtgccaggttttatctgatgggtctgagttatattgtacagtttacgtttggcctaatttctgtttaagtgggcagggagtgaaagtggggtcgatctacttaaacttttcctcttagttccagctttacatgtggtttggctggggctctggcctccaacccggttgatgtggttcgaactcgcatgatgaaccagagggcaatcgtgggacatgtggatctctataagggcactgttgatggtattttaaaggtaagtacattgtggatttgggttacaatttggctttctttgatgtcttagaccttccttcagttcttattattagttgctacataccattttgaagatgaaagaatcatatttttttagtagcttctcagttattcccaggtagaaaagctgtctccttagcaatctgctaatttgcagtggtacttaatataatgattcccatttgaatgctttaaaatacaggatgcttttattaatagtatcatgtagaattattgatagaaaagacaatatatcccccatttgcctacttcatacaacacagagaccctgcaatagaaaactcaatacttaaggaaaaaagcctgtattttatttcagttcacggttatgctgttgttcactttggctttgaaagttcctgctgttgtgtttgtgggaactgaatattctaaaagtattacatcattactggtgatattattgctactgaaaacaaattgaggctaaaatatgatgttgccatatggtttctctcctgttatcagttttgtttaacaactattacatattagacaccattttagtagttagagagaaattacagttattacaaaagtactataggtatacaaacggatcatcagtacagcctgataagtgataaactcaagagttctcaatttggaagcattgaggtaggctccctgtagatggtggcatcttgaataacaataactcatatccactgagtgcttttttgtgtgtcagcaactgtccttatgagacttatgtgtattcgttcattgaatcctcaccattactccacgaggtagacactgaagcactgaaagattaagtaagctgcctaaggtttcacagctactaagtgggagaactggaatttaaactcagatcacttgacctcaaactgacatttacctctccactatggtgctttcctcatattggtggccaagggttagattataaaggatactgaatgctatattgaggtgcttggacttttttttaacttgtcagggagctgttgaaagtttttaatcagattagctttgcattttaaatagattactttggctttatggagactggatctaccacagtggttcctcatcttgggtacacattggaatcacttgggagaactttcgcagctccctcctctaccttagaccaattaactcagaacctggggagtaaggtccaggtgtcaatattttaaactatatcaggtgactgcaatgttcacctaaggttgaagactactaaggggataagcctggagccatggttcttcaaagtttaacatgcatcagaattacctggagggcttgttaaactgcagttcacttggagccatctccagattctgatttagtaagtatggagtgggacctggaaatttgcatttttaataaattcccaggcaatactgatgttgctagtctggagaccacacttggagaaccactgacctacagatagggaagctgattagaaggctcttgtaatctgagaaagaggggatgaaggcctgaacttgagcatgataatggagatatagaaggtgggacagagtcaagaaagaattagttgatagagtcagcaggatttgattgactggatgtggaggggtgtgggagaaaagaggtgtcaaagataagttctgggtttttggagttggtgaccaggtggtgacattcattgacagaggcatcacaagaggagcacgtcttgggggagacatcctagttttggatactcagtttgatgtgcatgaggaaaatccagtggatacatatggatattctagccctgactcaagagagggttcatggatatagataaaagcccatggagtcattagcacacaggtggtatataactgtggagagagttgaccaaggagagtaggtagaggagttcacaacctttttgccttcccagcatactggagtactataaaattctttcccgtaataatgattgcctggggcagcaattctcagaccctggaaagtatagtttggcaaaagcccccattggtatttctgcatttgacaattactggtgtagagggaagagcactgggccaaggaaaaaacactgcagaataccaatttttatttatttatttatgcccaggctggagtgcaatggcgtgatctctgctcactgcaatctctgcctcccgtgttcaagcaattctcctgcctcagcctcctgagtagctgggattacaggtgcccgccactacgcctggcttatttttgtttttagtagagacagggttgcaccatgttggtcaggctggtctcgaactcctaacctcgtgatccacccgccttggcctcccaaagtattgggattacaggcgtgagccaccgtgccctgaccggaataccaatttttaaggtcttggcagatgaggaacctaggaaagacaccaaagacgaggaaacttagagagtagtgtcatgggagccaaagaagttaatgagtttcaagaaggaatgagtggttacttaatgtcacatgcaatagcgatctaatatgataaggactgcaaagagtctgttggatttaatattttttagaaggtttggtgaattggtgtttgcaaaagccaattgctgtgcattgaggaatatgtttgattattcattcaagtaataaaaaagaaaaaatcaagctgactcttgaagaggcccccccacacacacacaaaagaaagaaatgtttgtcttatgtgctaagcactgttctaggttgttgaggatgtactggtaaaccaaaatgtccctgtgtttatgacacttagattctaatagaaggagataaacacaggaagtaatgataaatagacaaatgtaaagcactgtttcaagaagattggctaaaagatttactgtaagatttactatacaataatatagtaatagctaatgtttattgaatgcttattctatcgcaggcactgtacatagagtatatcctttaactctcacagcgaccttgtggagtagatattatctttcccattttataaaggaggaaacttaggttcagagtagctaagtaataacttacacaagattacacagctaataagaggcaggtctgagacttaatccacaatctgtctgattccaaagtttgtacttacagccactatgctgttctgaatctgcagaaacatgtttttatgttggtagtaacctttaagtacttacatttgctcactcatttactcacttgctactaaaaaattttaatagcagtcattctttaaaatgactttgttctattttgccatttatgtaatagcatcagactttattattttgtctatgcttatctatagaagttctttgttttcacacaactgccttatgccaaaagatgcctcccagttctcacgttgtgaagaaattggtcactgtttttggaaatttataaagattcaagccgggtgctgtggcttgcatcctgtagtcttagctactcgggaggatcgcttgagccagagtttgaggctgcagtgagctatgtagtcttgccactgcactccagtctaggcgacagagcaagaccatgtttcttaattaaaaaaaaaaagatccagatggctcacaagagtgttagagacccttactgtttttgtgttcacctcttcaacaaatacttacgggaaaatttcttgcaccagacactgtgttaggtggtggtgacacaatggtgaacaaacaaagctagtttctaatctcttggagatttcattctagttgagggagacaataaacacacaatgcacagtataattttagatagaaatagatgctatgcagaaaataacagcatattgcaatagtgactcagtagtggggaactacttcagcaaggatggtcaagaaaagcctctgaggaggtgacatttgagctgagatctgaatgatgatgagctggccatgagagctgggagaaaaccatttcataaagagggaataggttactgaaggcctgagttggaaataagctggacatgttcaagggttagaaagaaagctagtgtggctgagtgtgtggtgaatgaagggagaaactagtaggaaatgaaactggagagaaaggcagcagctaaatcatgtgggatcctataggtctttgcagagactttgtaattagaatgaaatccaccaggaagccatttgagagctttaagcaggaaatgttatgctctcatttataattttaaaagattgttctagcttctaggtagagattttagaccaattaaaagtccattgtggtagtccaggtaagagattatgagattggatggtctttcagaggtctcttgtcatttaacagtctaggttctaggttattcacatctgggctttatttggggtgattttcacaattttccaacatcagttttggtctcagacctttactatttgctgaagatccattgggggaaacatattaccactatatcttcataaatattgtgcttattattttactgtttgttcccaaaagtagttagtaaggataattatctctagtatacttaatgtacaggatgggaaaaagaatatttacaactctggcttctcatattattgtcttatccaaatatatcctttttttagaattgtggtgggtttcacttcactattggaaaggcaaaataacatttttcaatgtctaacacaatgcctaacacactgtagttatgtaatagatatttgtccattatatacgaaccatttctgctggctaaattcagcacgtgccaccagtttacaacgtttatgcataatttatcatttaattctcataaccatgtatataagacccctgttgtataaagtaggaaaccaaaactcaaaacacttcacatttttcttcatgtaatcctcaaagcattcacatgaggtaggctatggcattatatagaatttataatgatgaaacagactcagagaagaataatgacttgcccaactttctattttcttaccctgctttagttctctttgtggcacttatttttggatataatatatatcaatttgtgtatttgtcagccccactagaatatgcactccatgagggtagaaactgctgtataggttacctattgctgtgtaacaaattactccaaaactcattgccttaaaccatttgttattttgcagtttctgtgggccagggattgcaaagcagcttagctgagttgattctggcttaggctgtctcctgaggttgtagttcatatggcaactagggttgctgccatctaaagccttgacaggctgggatagctgcttcagtgatcactcatgcagttgttggctggagccctcagttcctcaccatgtagtcctctcttcatgatatagcagatggtttcctctagagtgaatgaatccaagagagaataaggcagatgctttattatatataaaatatattttataacctagctatggaagtgacatatgttcactactaccatattctgttggtgacacagaccaaatactatggggtggaggctacgcaagggtacaaataactggaggtagggttcattgggggccatcttggaggctggctaccatagacactttttctgtcttgtttattagtatattctcaacatcaagaatggtgctttgcatatgtatggtaggtaaatatttattgattaagtgggtggatggatttagactacagatgaatttaaaatggacctttagagaaaagactattcatggagccataagttgccctggggtgggagtggaaggtgatgtcaaatgtagagaaaggtgaattcactctgtttttggttatatctttcctgcagatgtggaaacatgagggcttttttgcactctataaaggattttggccaaactggcttcggcttggaccctggaacatcattgtatcctttgagagaatgaaagcaagtgcttcaagctcccagataattctaggctatgggaaggaaaatttgattattaaagccttttaggctagtgagaaactcaagcatcccattggtgacccttgagaatcaaattaagcaaagaaacagctttcagttggaggctaatacaaactaaaagggatagaaaagatatgtcaaactttactctttaaaacaaaatgacaacaaacacagctaatctggaaggggctatgaagtttttagaaaccctgatggacgaagcctacaggaaagtccatgctgaggtggttcagatttcctacccctaactataggaccaaaatagctgggaaataaaaacaggacagaagacattcatggggtgaaggaatccacagccaagcaggcttctttcttcatgggtgaatctgtctcctccagttgtgtttgagtgcctcctaagtgcagagccatgtattggatactgtgtgtggtgttgtgtgtataatggtaagcaccgcagggttggaaagtaattctctgcccttgtggggtctgtagacagagagagggtatctcgttccctcttggaatcactctgatcatctaattaattatatgtcgtcactgatgttcttggttactgtgtgtgtgtgcgtgtgtgcgtttgtcctgtttccccctgaagactataaatatattagagttttactctgtttatgttgttcgatgccagtgatctgaatgggcacatggtaggcactcaatgcatgcttgatttgacaggtggtgttttatttatttatttatttatttttatttttttttttgagatggagtcttgctctctcgcccaggctggagtgcagtggcgcgatctcggctcactgcaaactccacctcctgagttcacgccattctcctgcctcagcctcccgagtagctgggactacaggcacccgccaccacacccggctaattttttgtatttttagtagagacagggtttcaccatgtcagccaggatggtctcgatctcctgacctcgtgatccacccacctcggcctctcaaagtgctgggattacaggcgtgagccaccgcgcccggctgtcaggtggtgttttagaaaagattttaaagcagatgcagcttggaatagcatagactaccttaatttaagagaatgcgatgctaattttagaactagctttggctttcgatatcaacctggtgatcttccttgacttactcctcagttttttattacatacgagcagctaaagaggcttcaaatctaagaactgaattatatgtgagcccagccctgccagcctttctactcctttgcccttttcccgtgttctaatgtattttgacaatgttgtaagtgtttaccaagccgttggtctcctaagggcctcctgatggaagaacagtggggtggttcaaagttatttctatgtttgtgttaccatgttaacttttccccgagagaaagtgttaacattgagactctggccccagattggtatcttctatgaagatggatactgatgggtgacattgaaaacggcctgctttccaaatgtggttaaatgtaattggttagccccagacttgggctagagcagaaggcataggccagggtggttattgctatatgtgttacagacctcggttctcattaaagtatttattggcagaatcactttggctttgtcttcatttactattttctcctttgccaactcttgaagttacattctccagagaataataaaggaagataactatgaaattgagactggactcttaaagtgcacttttatgagacgagaatgagtgcattgtgctttcccactgccattcattgtcataatgccactgctaaacgttgggcaggtggttctttcttaaacatgaataaacaagcaagtggctcatttggaagttcctacaggtaaaaagctaaaaaaaggcttaaaatagaagcctgttcccagggttctaatcatcttacaggtacaaagttctggctactttttttgtactgaaacagagcccggctcattgtaggcactcaaatatttgtggaattaatagttcttcatctttatccattcattaatttgttcaacatttattatgtatctattatgtctaggactataaaatgactaagacatagtgtctgttttcaagctcacatcatagtggaagaacagatttgtaagtaaataattacagtaggacctaagtactatgtgagagatgaacaaaatgctgtgtgggagcacagaggaggaacagccttacctagaggatttgccaaaggcttcatagcacaaatgacactcgaggtgagacagaggaagagtctatgtcaccatgaggataaggcattatacattttgacaaatgtgtaatatgtatctatcattatagaatcatatagaatggtctcactgccctaaaaatcctctatgttcctcttattcgttccttcctctcgcctaacctctggcaactactgaggctttttactgtctccatggttttgccttttccagaatgtcatatagttggaatcatacttttcagattggcttttttttttttaacttacttatatgcatttaaggttcctccatgtcttttcgtggcttgatagttcatttctttttagcactgaataatactctattgtctggatgtaccagtttattcattcacccactgaaggacatcttggttgcttcgaagttttgacaattatgaatcaaactgctataaatatttgtgtgtaggtttttgtgtagacattttcaactcatttaggtaaatataataccaaggagcacagttgctagatggtacggtaagggaatgtttagttttgtaagaaactgccaaactgtcttgtgaagtggctgcaccattttgcattcccaacagcaatgaatgagagctattgttgctccacatcttctccagcttttggtgctgtcatcggtttggattttggcccttctgataggtatgtagtggtatctcattgtttatattattattttttaaaacatttactatatccatcagataccctactcatccccaaattagcaaaagggaacatattttttgtttcacaatagtacagctgaaaatagtttctttttttgttgcccaggctggagtacagtggtgtgatctcggctcactgcaacctctgcctcctgggttcaagcgattctcctgcttcagcctcctgagtagctgggattacaggcacctgccaccacgcctggctaattttttttgtattttcagtagagatggggtttcactatgctgaccaggctggtctcgatctcctgacctcaggtgatccgtccgcctcagcctccaaagtcctgggactacaggtgtgagccactgcgccccgcctgaaaatagtttcttgaaggatttatatatattgcaaaatggctttagttcacctcaacctaaatattattccttcagaaaaaccttccagtgatttcctctcccccagtgtaaataactttcctcattataatttcatataccacatatcagaatttatatctatgtactatatgtgtgtgattatttcactaatttctgtatctcccatcatttggggctccatgaaaatagggattatgtcagttttgtttactactgggttctcagtgctttatacagttatgtgcacttagtacacatttgttaaatgagtaaatgaactggtctgtatccaaaggatctgattaaatgcctaaaacataggaaaggttcaacaaatactgtggaatttaaattgaattaaattaaaatttgattaactgggcgtggtggcctgtaatcccagctactagggaggctgaggcaggagaattgcttgaacctgggaggcagaggttgcagtgagccacaatggtgccactgcactccagcctggacgacagagcaaaaccccgtctcaaaaataaaataaaataaattttgaattattaggaaaatggctgtaagctaaggattactaaaggtatgaccaagtagcagggcagtgttttccatggttttagtaccatatatctgctggtgacttccaaatatacatcctcagcccatacttctcccctgaactccatatttctatgtcccactgcttattctacatcactcttaaagtctaataggcacaagttgggctcagtggcagacatctgtagccccagctactcaggaggcagaggcaggaggatcacttgagcccaggagcttaaggccagcctggacaacataacaagaccctgtctctaagaaataaagtctgaaagacacttcacaaaacaaaattctggatttgcccctaaaaacccttttagtggctcaggccttgaagtaatccttaactctgcttactctcttccacaacccacatcctttcccctaggaagtcatatttgaagggataaaatgataaccaaaatctgtaggttgtaagatgcaaaaactttccacttttttccccttttttttgagaggctggagaatgaaacaacccagataatagctaattaataattagcttaataattattagctattaataataggtaatacagagtatgggttttattatgtaccaggtactgtttaagtattttgtgtttatactctgtctacatccttacaaccagccctatgagagtaggtacaattctcctttttcagatgagaaactgaggcacagaaaggtgaaatacttctgcctcttaaacatggcagagtcaggattctagcccaggcagtctggctcacaatcccgtaattacaatcactatgcttgaggtatactgacttaaccttgtccagagtcacttaaagtttatggcaggtgagcagtaaagaatattgatttcattaattcccctatctttatagcgccgtgggagaaagaaggtcaatagtttttgtggttggtcactctttatcacttaacagtaacactggattaagattattttcctggagacctgtgactgcaaatacatcatttcccctttctccactttctcccgcttctccctcttccgtttgttggcctttcttctctgtgacctccttcatcactgctccacccccttcttcctccagtctgaggacagttcactaggggtagcacaacagtgttcaaaaagagggtcttgcagtcagagatggcacaccagaacaacatgaacttgttcctgttgtatgtaagaccatttgttgaagaatgtggaattattgatacagatgccactagtttgaaatttagtaatttggacatggggctaggctttccaccctttctcctccaatggaaagaagaactttgttacacttataaacaaatttataggaggaaggattactatgaacctgattataaattaaatctctattcaccaaagcatgtcacttaaggggtaatatttttattagcctaatctagtcaggatattgcatgtaggttaataaaattgctgggtattaaaaaataaatatcttcatgtcttctcaaaatggccatttctctctctctctttctctctctctctctctctatatatatatatgtatatatatatatacatatatatatacatatatatatatatatatatattttttttttttttttttgagatggagtctccttctgtcgcccaggctggagtgcagtggtgcaatcttggctcactgcaccctccgcctcccgggttcaagtgattctcctgtctcactcagcctctcaagtagctgggattacaggcatgtgccaccacacttggctaatttttgtatttttagtagagacggggtttcactatgttggccaggctggtctcaaactcctgacctcaggtgatccacccacctcaccctccaaaagtgctgggattacaggcgtgagccaccacacccggccaataatttttatttctgaggtttcactattaaaggatatttcttctctccattcagtgtctcagcatcagaattcagttgtattttgggctgtgctttacttaccataaacacttcatgcatccttgtctcttccatttattttgtaaataagaaaaaccatttaacactttcattgtataagattactaagggacctagcaatattaaagtggtggttggaattttgaataagaaatgtttggattatgagtctgtttttcacatttgaaataatctcagagccattcagctacaatttcttagtttagttttctcaccttttttttttaactacttctgagatgatatgatacccatttgcttttctataggaaatgctttcatatttgttgaatggctcaatggacacatctgcaaaaatactaaggaggggttggtgggtaaaagcacattgaacagttttgttatacagcatggcattttactgggcctgtgagtgtgttatctcagcaagcttatcagctttttagtgccttaatgtcaacacaattgagacagaactggaactgatatggatgtatcatggtaaatgggaactgtgattcaatcgtgggattgttgggcaacatacaccaaataaaaacaaacctaagcagatgaagagagcccctcaggctcttggccctacggagttttagtttccccagtgcttggtagcaactgaatcccgtctgccccattgtgtacaaggcgttttgaaagaaacaggaactgctttgtgcattaaaacagactcataggctcttagcagctgcatcagtcgtttctaggactcctcatgagagggctctttgagcccagtggctgattatggtcccaacagcttgtaaatgcagggaacatatggctgagtagtagcatgttaagctctcatgcactttaccctgccatggttgatccattaggtgaagcatatcttgccctttcagcaaactgcaagactatggcttcaaggcttcattcagcagattcaagaacggtttcctagctctgcgtgaagatgttttcttattctcatgtctactcagcattttatggagcaactatgtccgaaaattttaagagccaaaacactgaaattgatatctggatatcacactgcactgtattgatggagttgtactctgtgagaggcattcttaaactactatgttctgttagttcagatttctgaatttgcagaaggcagatgaaccctggcagtaggccatatcaaaaagtttccttttgcaaaaaaaaaaaaaaaaaaaaaaaaaaaaaagcaactggttaacttcctcagtatgatttattctttcaggaagctgtgtgcttttatctctttgggatgttcctatcagtgtggtctgttcatttatggctcacttatgacttctcttagcaggtgtctcagggaaatattacacttcaagaaatgctagcacaaatgtgaatcaaaattcttggcccggtgcagtggctcatgcctgtaatcccagcactttggaaggccgaggtgggcggatcacgaggtcaggagttcaagaccgtctggccaatatggtgaaacaccatctctactaaaaaatacaaaaaattagctgggtgtggtggtgtgcgcctgtagtcacagctacacaggaggctgaggcaggagaatcgcttgaacccgagaggcggaggttgcagtgagccgagatcgtgccactgcactgcagcctgggcaacaaagtgagactccatctaaaaacaaatacttataaatatttaatgctccttgatctagtaatactgcttggtgaatttatcctaaggaatgggacagagacatgccaatgatttatacacagggatatttatcatgctattataacagaaattagaaataacctaagttttagcacagctatagggaaatagttaaagtattataccatttgttgaaaaagcatgcaaccattacaagttgtgtttttgaaaaagacgacataggaaaatatacacaatataatgttaagtgaaaaaaacagatgaaggagaataacagtggtcatctctggatagtataattatgggtactttgtgatttcctatgtttgcaaaatttttttaatgaacaaaagttgtttttataatcgtaaaagaaatagtaaacatcatttatatatcaatctatacccctagaagatatcccagcaaagctggggcaattttagcacatagctctcaatgtttgtgagataggtaagtggacagacggatgaatgaatgacgattggcatttgtaggcaccatcattgaatttataagattgcagaaataacaagtgaagattttttaattaaaaggagaaaattccagacctgtcagcagtttgaaggatgacgtggaaaatactgaaggagccacagaattgagtggctgacagtagctgaggagttgtggtctgtcattgggtccattgctattcttgtttttgctgattctatgtgtgtccttaagtatcttgtgcctgctgttttcactggtctctattcagtttggccagtgactgagcatggtgggaatgaaatcaaggtcatgagttcaattcccatttgaaccagttaacacttctccttctagggagaagatatcccaaggctatctctggctgacactggacatatggacaagcaggagtgtgttggtcagggtaacctgcctctaacacttgtgaaaccacttaaaacacctctgtacagaggcctacagtgtccttatgttctttgagaatagtcctctgaaattgaggtgttgatatgtataacctttcctacctaaggaattaatataaaacttagtcatgttacaattttaattacaaattcagcctggtgcagtggcttcctcctgtaatcacagcacattgaaaggctgaggtgggagcatcactcaagactatcatgaacaacatagggagaccctgtctctacaaaatataaataaattagctgggcatggtggcatgtgcctgtggtcccagttactcaggaagctgaggtgggaagattgcttgagtctgggaagttgaagctacagtgagctatgatcgcaccactgcactccagcctgggtgatgagcgagaccctgtctcttaaaacaaaaacaccacaaattcacagtaagctgttcatggaaataataaatgggactgattggcctacattgcatcctacaaggtattaatatctgggatgttttgatcaccttgctgaactgaatctggtttcttggtaagcctatcaggaaacaacatcagatgtatgaatgaaatctaaacgtttccggtacattcccttatctgtgaaggagcttgcatcaaagaaagccattagacttttgtgtagcatcctgtagctctgctcttggtggcttattaaacacagtgttgttgctgtttttttttttgtttgtttgtttgtttttttgagacggagtctcactctgttgcccaggctggagtgcagtggcgcgaccttggctcactgcaacctctgccgcccaggttcaagcgattttcctgccttagcctcttgagtagctgggattacaggcgcctgccatcgtgcccagctaatttttgtatttttagtagagacagcttttcaccatattggtcaggctggtcttgaacccctgacctcgtgatccacctgcctcagcctcccaacatgctgggattacaggcgtgagccaccatgcctggccaaacacagtgtttttaattgtgattactcttaaatccaattaccatactagtgccagtgccttgtttgtatccgctctgtcttgatactgctaaggtattagatttattgtttgtctttttcaacctgaatcacctctcatcactcatttttaaaaatcttattcagaggttgaggaatttacagttctgagtccaattgtccttgtcctatatgtcataatatctgaatatgagggactcccttaaatgggtcaactgactgtttagtccagggtgtttaaagaagaggaagagaactgacatttttgagcactaacaatgtgctgtagtttactagatatttacatatacattatctgagttaatcttcaatataaccatgtaaagtaggcattattaccccggtttgatgaatgcgagatctagtttgagaatttaaatgactgaattatcatttgaacactggtctgttggatttcaagacctgtgatttttccattgcacatactgactcccaggggtagcagagtttcttagattgaacctaataacacactgatcacctggcctctcctcccctcctgcttttctgtacttaaaaatatatatattttttatttttaattgacaaataattgtatatattacgtggggtacaatgtgatgttgatatatgtttaaaatgtggaatgattaaatcaggctaatttacttttttttttctaaaaggaccttggcttcagaattaactttaattttcattccactttgcttatattatcttggcaagatcagtcctttgtagcaaggccaggatttaagctttgaaccaccagtaaggagggcattggtttgagcctgctttcaattttgtccaaaatccagttattcgtattttacctagttcccagtaactcacaatacaatccaagaatgtgccttattgctggcctggtacttgctggatgctcagcatttcaaggcatattgggttccatcgtccacttgagagtcaaaaagttcttcagttgtaggaacacgatgcttgctatggtgaaagcaagcatgtttctcctctgggccagactggtaagcaaagcgactgcaaaaaatttaccaaaagtgggttgatgtgtatgtagtagaatagatcaatgagaaacagccatttgggctgaagaagatatagggtgaaggtagggagaaggaaattttctcaagagtagggaaactgaaaaggatgatcattatcctctgaatgactgaggaaagtaagctgggagttaatctaagactaaggggaattaagaaaatccgagtgcaaagcatagtggtgtggtgacatcctttgaaaggagggtggctggattccatccaggtctaaacattataatttgtgattagaatgaaaaatttcaagggcctcttggaattagccattacacgttggattcaaatgcatcctcaggtcattaatttagggatattgagggattaaccaacctaaggttggtacctaatttggtacctaattcagtaccaaatcctaggcaagttaatccatactgttttggtttcttcttgccctcttttgttgtcaacttggcagctttctggggcaatattacagtttaaggtcttgagagccaaactctctagcaatccactgtggagaccaggaggttttggagagggttacagggaaactcagaaaggcagagagtggttcctgagtgtcttcgctattctgttcttggttttttgctgccaggttgcccagagggaaactgagcatagttcccatctgccaaccttgtcattttctgtaccccacggaaaggaggatgaggcacctgctcctcagctggtctcctgtgcaacagtttcttaggaaaatgcaaaattgggagtaagtggaaggagccctgaggagcaaagtggctccagtctggagagcttggctgtgcctgccttggtacccacatgttttctctctcttccctcccagtgcctcagaatttgtgatccagcattgtcatcagcaagtagccacaagtgacatatgaggccatcttaagggaaggggcagcagagagttaaaaggtggtggattgggaccggtaacagcagaaataatcacaagatagtgtttctttgggaaataacctattttaaacatcatgaggtgtgcgaaaagacaagctttagaggaattgaggtttctaccttttaggcacattcaccatataagatctctgattaatatcagtaagggcaggaggaggagggactcctcaccttgccaaagcaattactgtagtaagtcactatagtaaacacttaaaaataacagaacctcatttctctagtgttgttcagtatgggagccactagccacatgtggctactgagcatttgaaatatggctagtttaaattgagatgttttgtaagggcaaaatacacaccagatctcaaggacttagtatgaaaaaaaaaccagtataatttttatattgatgacatgttgaaaacaatatattggttacgttgggataaataaaatattagttttgcctgtttctttttacctttataaaacggttactggaacatgtaaaattatgcgtgtggctcacattatatttctgttggacagtgctgctctggtatactcaaaaatagaatttgatctataagcatctttttagcagtacatttcttgctttaagtaagtgtacctgtacaccagagacaggctcatttcaaaagaaggacagggaggagtggcgatttgaaaatggggaaactgattatagaagaaagtcaggactctgcctcagttacctgtcagtctgggggtgggggatgctgggacaggggtcaattgcctgaagcaagtgctctcatccccctagctcctgctgatctagttggggctccagagtggggaggagaaaggcactttgaaacttctctgcccttaccgtcttagccatcaaactctgagctggagatagtgacgatgtgacaggaactttccctgggcctctctgggccacaattcctggccgagagaaagaggaggaatgaggtgagcaccttcttcactcctagggccatgtggtagagctgcagtcgcacctccttctgccaataggcatagatgagtgggttgagcagggagttgcccacgccgagcagccacaggtaccgttccagcactaggtagaggtgacactcctggcaggccacctgcacaatgccagtgataaggaagggggtccaggatagagcaaagctcccaatgagaacagacacagtacggagagctttgaagtcgctgggagtccgtggggatcgataacctccagccatggctcctgcatgttccatctttcgaatctgctggctgtgcatggaggcaatcttgagcatgtcgcagtagaagaagacaaagaggagcatggctgggaagaagccaacgcaggagagggtcagcacgaagtgagggtgaaatacagcaaagaagctgcactgccctttgtaggcagtctgctggaacatggggattccgagtgggaggaagccaatgaggtaagacactaaccacagcccggcaatgcaggccccggccacgaacccactcatgatcttcaagtagcggaagggctgcttgatggcaaggtacctgtcaaaggtgatcagcatgaccgtgaggacagaggcagctgcggaggaagtgacaaatgccatccgcaggctgcacagggtcttctgtgtgggccgagaagggctggagagctggtctgtgagtaggccagagatggccacaccaatcaaggtgtcagccacagccagattcaaggtgaagcagagactgacaccatcattcttgtggatcaacagcagcacagccacagccactagtgtgttagtagcaatgatgagggaggccaggacagcaaggatcactccaaatgagaaagatgattccatgtctcgaagtggcaggacttcacttaccagggcatgctatctctccagctgaaattctcatgggccaggggcagaggagctgtgggttcagagctacagcacgattctggccttcgctggcagtccaggctggcaggtcgccatctttgggatcctacaggtcatgaagaattactcaccctctcttttcagtcctcagcctcctgcctctccagctctctaaaggcagcaacttcagtatagacctccccctgggccctgagctagtccctccccctccaaccagcaagttactagacaactcccaagtacctgtacatgctgtctcgccaggccctctcccttcactggtgcttcagggactctggagggacagggacattcatcaggtctcctgtctgtcaaaagatataattgactccaatcatacttttttcttcctccataccttgacattaaatttctacttttcttccaaaacctcgagtaccagcttaaataattaatctcagcttaattaagctttttcttactaattctcaattactattatgaattgcttttaatcaagcaagatgctcataatcagttgaagtgggaagtgagggaaggtgagctttttgaggggccccagcatattttcaggagtgctaccacacatttaagctgtttcttaccttttgcttcctagcgcctcaaattctaattctctcaagtagggcgtgctgttcccccgtttctcatccctaggatctcagttgaggattcaggacaggaaaaacagggccaaaaactgttaacagctgtcattcagtttagaacccattctccacctcacgctgctgtctctcaagtatactaattgataattatttctgcagcatgttgggccaggtctggtcagtgagtagtggctgctgggcttgcctttcttaatcctatagacctgaggtatctctgcgggaggagaagaggagatgagctgcattctgggaagtgtctgcttgatgtttggctatggaattttccattttccaggaataggaacgtgggggcggttgagggggggaggttagaccaaagggcaactgtgttgctgaagcaggtgagatgcactctggaggggcagctgcataagtcactcctgttttaggatgtgtatccatttgcttgggtacattagaactaccctttcgcctgccactctcatcttggataccaagaagagaggggtggggagaagagtggttagaagcttatttactcagttcaggtgagagcacaaatgggaaaggttagtgtttgaagtgagggaatagagagcaaggtgcagagttggacgcaaatatattccaggatgttttgacagtctgagagggcctttggcagatgtctctcctaaaaaaggatcagaaagactgtgttgtggggattcagtattctagttgccatcctgaaaacagttcttattctttggtatgtccattaggagattgattccagttgcttagaacctagcctaattttatacctggacctaaggtgtgcttgggtttccccagctcttgactccacggagtcaagttagcccttttcaaacccatgttcaaacttgagagtgtatcagaatcacctggagggtgtcttaaaacccaggttcttgggtcctactcccagagtttcaggtcattggtgagtctgagaatctgcatttctttctttcttttcttttttatttttatttttatttttttttttttttgagaaggagtttcgctcttgtcgcccaggctggagtgcaatggtgtgatctcagctcactgcaacctccacctcccaggttcaagcaattctcctgcctcagcctcctgagtagctgggattacaggtgtgcagccaccacgcccagctaattttgtatttttagtagggacggagtttcaccgtgttggccaagccggtctcgaactcctggcctcaggtgacccacctgtctgggcctcccaaagtgttgggattacaggcgtgagccaccgtgcctggccagaatctgcatttcgaacaagttcccagatactgctgttacttgctcagggaccacactttgagaagcactgctctagtgcaatggttcttacccttagcagtgcattggaatcacctggtgattccaaaaaatactgctgtttgggccacacaccaagagattctaacataattattctgggtggtaactgtgcaatgggagttttaaaagttccttgggtgattctaatattcagccagggttgagaaccactgtccttggtttcctcatgtgtaacatggggacagtcatagttatatcacaaggttgtgaggatgataaaacgaggtatgatatgggcaaagacttcatgattaaaacaccaaaagcaatggcaacaaaagccaaaattgacaaatgggatctaattaaagcgcttctgcacagtaaaagaaactatcatcagagtgaacaggcaacctacaaaatgggagaaaattattacaatctattcatctgacaaagggctaatatccagaatctacaaggaacttcaacaaatttacaagaaaaaaacaaccccatcaaaaagtgggtgaaggacatgaacagacacttctcaaaagaagacatttatgcagccaacaaacatatgaaaaaatgctcatcatcactggtcattagagaaatgcaaatcaaaaccacaatgagataccatctcatgccagttagaatggcaatcattaaaaagtcaggaaacaacagatgctggagaggatgtggagaaataggaatgcttttacactgttggtgggagtgtaaattaattctgccattgtggaagacagtgtggtgattcctcaaggatctagaaccagaaataccatttgagccagcaatcccattactgggtatatacccaagggattataaatcattctactataaaaacacatgcacacatatgtttattgcagcactattcacaatagcaaagacttggaaccaacccaaatgcccatcaatgatagactggataaagaaaatgtggcacatatacatcatggaatactatgcagccataaaaaagaatgagttcatgccctttgcagggacttggatgaagttggaaactatcattctcagcaaactaacataggaacagaaaaccaaacaccacatgttctcactcataagtgggagctgaaaaatgataagaacatatgggcacagggaggggaacatcacacaccaggggcctgttgggcgggtggggggcaagggaagggatagcattaggagaaatgcctaatgtagatgacagattgatgggtgcagcaaatcaccatggcacatgtatacctatgtaacaaacgtgcacgttctgcacatgtattccagaacttaaagtataataaaaataaataaaaataaatttttaaaaatgaggtatgatagttatgaaaaggcttcataaagtgtaaaatgttacatgggtatccagtgtcttctagtctctgctaatcaaattaacacactgttaatcaaagtgtgtatcagaagcattgttatgacctgagagcttgttagaaatgcagaagctcggccaggcacactggcttacgcctgtaatcccagcactttgggaggctgaggcgggcagatcacttgaggtcaggagttcaagaccagcctggccaacatggcgaaacccagtctctactaaaaatatgaaaatgagctgggcgtggtgatgggtgtctgtaatcccagctactcgggaggctgacgcaggagaattgcttgaacctgggaggtggaggttgcggtgagccaagattgcgccactgcactccagcctgggtgatagagtgatactatgtctcaaaaaaaaaaaaaaaaaaaagaaagaaagaaagaagaaatgcagaatctcaggccttactcaagacctagtgatgcagtctgcagtttaacaagatctccaggtgatctgcatgcacatttatctttgcctctctcctactctcaggtgtctagctgtattagttttcttttgctgctgtaatgaactaccacaaactgacttaacacgaatgtagtatcttacaattatcaaggtcagaagtccaaagtgggtcttacagggctgaagtcaaggtgttagctgagctgtgttccttcgggaggctctagggaagagtccatttcctcaactttttcagctctcagaggctgcttgcactcctaggctcctggacacatcactccatggtcacgtcttcttctctgaccttcctgtttccctttttttttttttgggacaaagtctcactctgtcgcccagactggagtgcagtggcgccatcttggctcatcacaacctccgcctcccgggttcaagcgattctcctgcctcagcctcctgagtagctgggattagaggcatgtgccaccacgcccagctaatttttttgtatttttagtagagacggggtttcaccatgttggtcaggctggtctcgaactcctgacctcgtgatccgcccgccgtggcctcccaaagcgctgggattacagacatgagccaccacacccggccccctgtttccctttttaaaggacccttgtgatgacattgggtccacctggacaatccaggataactcctccatttcaggatccttaacttaatcacatctgcaagtatcttttgccatgtgaagtcacatattcacaggttcctaagattaagacacgaacatctgtgttgagggacatttttctacctaccacgctggtattctctgctgcatggatctcttcccccccaaaccccccttcaacagtctgccattggaaccaggctactgggagaggaactctaggaaggtagccaggataagccaggcctaatttctcatggtgcctcgatcagccatgtgcctgtgatgatttagctgcatcttgcctaaggacaaaggtgtagcgacatttaataaatacctcttcctgaatgactagactggtacatatattactataaaatattatgcagcagtgtgaaaagaatgatataggtttatatgtactgatataaagagacttccaagatatgttgttgattgacaaatcagaaaccagtttctagagtcttggctcacttatgaaaaaaacccctgaacccaaatatatgtggatgtaaatgcacagaatgcatagaaaagagactattaacaaagagtgaataactttgaggagggaatgggactggtgggggctgaagagtcacgatttgctttgaatactttttacttgtcatatatatatataatatataatattttattattattattattattttgagacagggtctcattctgtcgcccagactgcagtgcagtggcacgatcttggctcactgcaacctccgcctcccgggttcaagagattttcctgcctcagcctcctgagtagctgggattacaggcacctgccaccacgcccagctaatttttctatttttagtagagacggggtttcaccatgttggccaggctggtctcaaattcctgacctcagatgatccgcctgccttggcctcccaaagtgctgggattacaggcgtaagccaccgcgccggataacttgtcatatattttcacagcgagaatgtatctatgtaatttcaaaagaaacaaacatgccccttaactacctctccctgttccaacccaggcaccattttgcaaagggattttccaaacaacacaaaagtgcatgtgtgtgtgagtgcacacccatgcaaatatatatagtcacatatctcttaatgatagagatacgttctaagaaatgcatcattaggcaatttcgtcattgtgtgaacatcacagtgtacttacacaaacctagatggtatagcctactgtacatctggggtatatggtatggcctattgctcctaggctacaaacctatagcttgttactgtactggatactgtaattattacacaatggtaacaattgtgtatctaaatatttgtgtatctaaatatatctaaacacagaaagtatttgtgtatctaaatatatctaaacacagaaaaggtacagtaagaatacagtattataatcttatgggaccaccatcatatacgtggtccattgttgactgaaacatcattatgtgccacagaactgtatatatttatatatacacatacatatatacactattttatgtatgtaatatatgttatatacaaaatacacagatacatatgtacactatatagtatacacattatatatattaaaataacacatacatacatacatgaaagagaaagagagagagagagagagacagagacagagacagagaggatgtgtgtttccttttatttatattgctgttactagcctgagctacaactgtaaagagaggggtatatgtggattgaaagaaatgtaggacatgacagggtgggagaatcagtatttgaggctcttcttggagtgggaggcgctttgaggaaatagccctatccttctggggcatctgagtcttcttgcagcaatggatgacaccagctaacatttatggggcctttaagtgccaggtactgtgctaaatatacaacatggagtttcatttaaccttcacgacaattctgtaaggtaggtactattcatgccttgattttacaggttaggaaatcaaggcacacagagagggtgacttatttccaaagggctacaccacttataagtggaagatgttggaaatcgacatacaggccagcagcttgtgtgagacctgtggacagccaccaagagttcatcccatctcatgtcaaccacagagattacatcttgtccccttttgttaccagtttgtgtctctgtgcctttgcacatcctatcacactggccttcaagctgacacttttatactctgggtttttttaaggtcgttaggctgagaagtagtagaagcctttctttttaaataaagtccaatgatcatggaaaatgaggctcattttaccctgagcccaaggaaatgtataaatctggactcatgtgtacctctccatttatcttatcactcctgctttccattcctgctattgcctctttcattcagtactttattatctttcatctgcactattactgtagccttctaactactcatcctgtcaccccacacaaacattgcctacacagcaggtttatggagtgcctattctatgttagttactatgataggaaagagcttttcatacattcaataacatgttgtgagctatgggttattatctcatctccatttcataagtaaagaagctgaggcttggagagataaagggacctgcccaaggttacccaactagaaaggggtggcagagctgggatttggaatccagttctccttacgcctggtccaatggtctttttggtattccatgttgcagaagcctgggtgtggtaggctgaataatgccccctgcatagatgtccatatcctaatccctggagcctatgaatatatgaccttacttggcaaaagctagtttgcagatgtgattaagttgaggatcttgagatggagagattatcctggatttttcctgtgaacccagtgatatcatccctgtgagcccagtgttataagggcccttaaaacagggagtcaggagatcagagtgggcagttttggagatgtgatgacagatgccagtggttggagtgatgcaaggaagggatcacatgccaaggattcaagaggcctctggaagtcagaaaaggcaaggcaaggaatcctgtcctagagcctccagaaggaatcagccctgccaacactctgactttagcccagtgaaactgatttcagacttctgacctcgagaactggaagataatagatttgtgttgttttaagccacaaagtttggggtaatttgttacagcggcaataggaaattaatacattggtttcaagggttagtatgtggagacaattcaaaaactaggtcctggttatatcgctgcttggcggtggttactgcccaagaggcatttggttgcaatactacaagtgttcctacatagccaggaaacagcagcattgttggcctgagatgccaaaatgccagtggccaggaagcccagcagagggcacactctgcagggagaaagtaatccttggaaaggctctgctcctgtttagctggataaataggacactttttgcacttctgggttgctctgaatttgttgcatcttagctgggattcatgcaagccagagtagctcttcagggacctagcatggtccctgaagacattttcatttgtcactcaggactcagaaccttcttgctccattaaaaaaaggatttatatagttacaactagtaggctgaaatccttccgtcccctgcagaatagagttgagtaaaaacacacatacctttttggccgatgtccatggcttgtggaatggggtggggtgaggggagaaaatatatattcaattaatgtttctagcttttttcattgcaaatctttcttgaagtgtattcttcaagaaagacaccagtcagggggtcatgctaggctgagttttatatagcagccctccaactctcagaaagcgatttccacctttttcctaaggaagaactggtttcgttcactagggggtaagatttgtgggttgcagaaggggtcagggggtttgtaacaatggctgggagtatttggaatgtgaaaagaatataatattattataaatattagtaatattcacctcttatcacaatccttgcaagatctctaagaggtgatattatcaccatttcataacttgggaaggctaccacaaaaaagttaattgaagctaattaaattgcccaagtttctatacctagcaagtggtagaactgggatttgaactcaggtctgccaagctctatgtgtcccacctgttctctccagaatgtaagttgctgaccagagatggaatgcaagctgtgtggcatcatcctatagccttgaaaacctgcatccaccctcaagaaggatgccacctcctgccattccagggtagaatgctgccagccttcatgcaacatcattgtgatttgagccaagacagacccatcctgtgcttcttctctagaagcttagcattgtctgtcagcttgtccccgagcactcatgtgctctggtctttacattgtcatgtctcagtgatctggcttctttgagctgtggcccactcattcctttccctaatttgtagaccatctcctataccctggatcagtgtttcatctagcactcccggtaactggcttcttcacctcaggcaacagagcaccccaggaaaactctggctcagaacagtgaaaatgaataagaggagggtaaaagctgcccgtgcaaggaatcttttggagaacagggagtgggcactagtcattggcttgggaggactgacctacctaggtgaaattgtgatgaccatttgggaactcttgctctaggtaggtacctgttatccctgaaaaatacttttacattcagctccagttagatctgcccagtgctacttctcctcccaccgggtctgattgtcccatttggttcagtccagccagcatgccctttaggcccgcatgccaatgggaacttcacattatgaatttagagtaaatgtgatttgtgattacaggtgggttctaccagaactagagtcatatgctcctccagcactttttttctctactttctccctttcttccctggaactagattctgctttttaatcagctcatcaagaatcttggcagcttctgaaagttgtgctgcttgaggtatggaaaatcgctgcattggcttaggcagtggaggaaaggtgaacaataacaggcaggtggtaaaagacatctgttgtgcgtcttttagaagtcatactcacccctggaggcaacttggcctcctcctcctcaagagtttgggattctttttccaatccctcaagagtctacgtaagcatcagattgctgggagcaagcagctgtgctgagccacgggggagctcagggcagcgcaactgtgctttcaatttatctatctctgactcacataactcacgagaattctactacaacacctgcttgctaagctttgcaaactgctctcagttatctgacggtaattcataggtaatcattagatgctctaaatcaactgtccttagctattgtttttgaactatggaactattttagaatcttatgggagctatggattttctaaaaaatgcacatgttcacatgtaaacacatcgtacacacaaattcagggtcctcacagactccctaaagatcatgcatgtatcttaagtcaatatccctgaagagttgataagatcttctgttaatacaatgcatcatttcttattttcttattcctaggcaacctacaattaaggaacagactttataaacacatacacttaatctgctttcttaacacaaggaaagtatggcccacatccattcttttagacttgtgttttgcttccatccgacacttaagtcttcagcatgggagaaggtaagtacacgatggcatgctgtttagatttatgggtcctctcaaatcagttttcctgatggtgatgttgttttggatcaattgaaataagtgggtgaaaacattgaaaaattaaaggtgcttctaccaagagaacttttctgcagtgtttgataataatgatcacctttcactcccttttactttaatataattttgtgttttttttagagacagggtcttgctctgtcacccagggtggtgtgcagtggcacaatcacagctctctgcagcttcatcctcctgggcccaagtgatcctcccacctcaacctcccaagtagctaggactataggctcacaccaccatgcctggattttttttttattttttgtagaaatgggggcctcattatgttgcccaggttggtcccgaatgcctaacctcaagcaatcctcccaccttggcctctaaaagtgttgggattacagatgtgaacaactgggcccctccccttttcttttagaatacacgttctcccgctttttcatcttcctctgtcatcctccttctcagtctcctttattgactcctccagtatttttaactgatttaccaattgaattcattagttttcttccaaaccagtcttcttgcctgttttaccttagcaaagtgtgtcacacccaattagtgtctcaagctggaaacctaagcatcatccttagatgtttcctcactacccacatctacttgaatcagcatgttgtggctatgaaatctgttgactttgtttgctcctgctcatcacagccaactggtatcctaactgatctcccagcatcaagacttgcatgccttcaatccatcccccacactggttccaaagtgatcaaagagaaaattgaccacgtcactcccaggctcaaagaaacatgctcggattatgtttttgtccccacatatgttttccttatagggtgagcatgttcacctttatattctcagcacctaaagcagtgtctgcctatagcaagtcctcaacaaaagtggtcagctggttgactggttgaatgactgaatgattaagctatatgatcacttctcattgcctactagctagaatcagaacttcttggcttcatctacaaggcccttaacaaaatggccagaactcttccatccttatcttcagccattaccactctgccccatcccatcccctggtcacatcatatgcttttcacactttgatgcttttgcctctggtggttccactgcttgaaatgctgtttctgtgtggtacccatcctgcgtcttccatctacatgtgactgccttcaaggccaagctcaacagtcacctgactctatgtgactttccctgacaatctactttccacccccagcttcctctgacccccagcaccagaattaattatccctcagctggttctaaaggcatttcactcatacattcaatatgacattcatcaccttgaatacaaagtacttatttatatctgtaactatcttgtaacaccgtgagctgctcaagggcaggtactgggtcatgtggtcttattcactgtagtatccccagcatctaggccagtgtctgggcactgacaaacaaaggatgtgcctttatgttggtgtcatgtgtgttcttatttatttttatttaaaatacattttttttttagtttggaacaataccagcatggaacaccatcttctttgctgtcacctggagacaaatcaccatcatccgtcgtctgatttattgtagagcttccaaactggtcttcctgcttctactgtaggcaccccctgccccctccctggtctgttatcaacacagcagctaaggtgaacctactaaaatgtacatcagatcaaagttctttggtgactccctacctcacactgagtaaattccaaagccagtacccagcatggccatgtttgatctgttctctttacctcaacttatcctgtgtataggggttaagagtgcagactttggagctatatgacctggattcaaatcctggttctaccatttaccagctgtgtgacctagggcaagcaacctaacctctctgtgcctctcttttctcatttaccaagtgaggataataatatctgcctcatagggttgttgcaagaagtaaatgaatttatacatgtaaagtacctagaacagtgtcaggtacatggtaggtactaagtaagattttctcaaataaacaaaaatctatcattctcccccttgcctactcctctccagccacactggcctcctttctgtttctgaaatacactcaaaagagtgtctcagaacaatactgttttaccagacactcacatggcttcctcgctgtcttcctgtggtggcacacgcctgtagtcccagctacttgggaggctgaggcaggagaattgcttgaacctgggaggcggaggttgcagtgagccaagattgcactactgcactacagtctgcgtgacagagtgagactctgtctcaaaaaaaaaaaataaataaataaaaataaaaataaaaataaaaaaaggaaaattctaaccatatagaaatgaacaaagggaaaataaaataaagtcttctctacccctaccctcatctgttttcctaaaggtaatcatagttgtgtgatttttcaatttcattaaccagtaagtatattggttgcattctatgtatataggaaaatgttcgaggcttgaggttctgaggggcttataaatgcagatcctttaccttccaggatttcatggtctttctgggagaagaacataaaggagttctgtagtgttacagagttcagaagtgagagccatcactgtgggcacataagatcgggaaaggtttcctgcatgatgaatgacttgttgggggcttggggcttgggcagatttcagtgagagagaggagggtggtccagggctatgaggctctctcagcagaggtgcctaggtgggatgatgaaaggggccttcgagggaatggatagaagtggagcccggcttaagttgagttttttagtgggggagcagtgacagaagagaatggagagtaggggctggggcagctagaagagtactgaaagagctaggaggcatgtactaatggctcagataggactgtgactggaagagacacattttatagatacttcaatagtacaattgttaggacttggtgagtgaatggatatgttgaggtgaagaatagggaagactgaaatatgaaacccatgtttttgagtatgggcaaccaggaaaatggtgataatattgcccaaaatagggaagtctggaggaaaaactgtttgggggtgtggtgtggtggtgggaagttgggagatgactctggctagatagttcagcctttccttgaatgtggggactgcctttgactaccttagcattaccctcagaagctagaactaaatactgcatagaatattttctaaatggatgctattggtggagatcacttatagccaccttggatgccaaaccctcgttctactttcagatgttagattcagagggtcctctgcatccccacctcttttcaactcagacttacgggtatctctaggcatcatcttacctaccaattcctgccaaatgcaagtacatctatggaaaatccgacttccttgcttcgttatttacttcaggatctcctagggtgatcaaccatcatggtttgttctggggttgccaattttagctccaaaagtcagaagtctcagaaacctctcagttccaggaaaactggagcaatattcagctctctcaccttcagaatacctctgctgaacctaccagctgcatagtaataatagccttctcatgttctcaatctaaattggtcttattctactcttttgctccagcttctctcggaacactgatgactaatccccaggtatagtcttaactctctcatttcacagccatttgaagaagtcagcaagataatgctgcatgctagtttaccactctgcaatggctacttcaacccacaactaagcaacctgagattcctaggagcagataaaccccatgtgcaatctgtcactgtttagctttcattgccaagataattttacaaagttaatgaatagctgggttggaatggggaggggggaacagacacagaatgaatgaggaggaactgtcattggtgggcagcctctgttctccttcttggcaggacattggttacatggtgggccacttgagggtacagttgttatcatcatcaaaatgcttttatgaaggacctaatatctggtgctctgagttaggccgcacagctctggactttcacttttagaacatcatagtccaagagcaggtattgatgtggacacatgcaaaatggattcaaactgtcaatatgggttaaatcacatattatacattaataatctcttccactggtttctagatatttctggttgaaatctatcaagcaaatatatcttgtccccttaattataatattagctccttgaaggcagaggacccaccctgatactcctgtctacagaccttagctgtacaggacaaatctagatgttcagtaaggactgattaaatcaacctgacctgacgggtgcaggtagagtacctttcaagttaatttattcctttgagcctcatttcttcctctacaaaatgagggtggaaattttttttcttttctttctttttttttttaaataaaaaggagtctcactctgctgcccaggctagagtgcagtggtgcgatctcagctcactgcaatctctgcctcccaggttcaagtgattctcctgcctcagccccctgagtagctgagattacaggcgtgtgacaccatgcctggctaatttttgtatttttagtagagacagagtttcaccatcttggccaggctggtcttgaactcccgacttcaggtgatccacccgtcttagcctcccaaagtgttgggatgacaggcatgagccaccacacttggcccccctttttttccctttattttagagacagggtcttgctatgttgcccaggatggtctcgaactcctgagctcaagcaatcctcctacctcagcttcccaaagtgctgggattacaggctgagctgctgtgcccggctagggattgtaattttctctgctttattgggttgttgtgagggtggagagacaatacatgtaaattgcttagtacatactctagcatcgtatagtacatcatctgctcaattgttagctattaatttaacaatattaatttctgcctcctgctcaactaggagagagcctatggaaaagagtaagtgcagcagttctcatgcaaatgtgtaggtattcgattcagcctatagaagcacactggtctgttgcctatgtattgggataaggacaacagaagatttaccttttcacctatcttcttcacttttctgccatgacagggatgctttgatgggtctgtgctttagcaactgactaggagcgaaggtccaagtgggactctggactgggagcgagggctgagactaaagtcgccacatcaggctgcttgttccgttcactcagcaaatatttatagctaatctaaccagtttcagatatcgttcaagaggtgggggtcctgcaacagcccaggcttgtgcctttaccccatttcacagagaagaaaaagcgaaaaactagagaaaaaccacctctccaagaggtaaccgcacgcagcgcggaaggctgctagtgcgcaggcgccacgccccggtacgccccggctcttccggcgcgaggtcaccgaatcgactggccactggcgccggggccgcgcatgcgctgcgctgcctttcccgggcgctgattcctgagtgctgagcgcgaacccgaggagatgaagtaaggcgtcagcttccttttgaggaaggagcagcgggccactgggggtggtccaccgggactggtgtggtagagcgtctgcggggccgaggggcgggagcggcgcggggactggaacagctcgtcccctagttttgctcttcctcagctccggccggttcgcacttacttgtctgcttttctgcctaccctccccaccccccccgccaccgtgaagccctttaactaaggtgaagctgatcaacgagctgaatgaacgagaggtccagcttggggtggccgataaggtgtcctggcactccgagtacaaggacagcgcctggatcttcctgggtgaggtccacatctttcttcctcagtgctctccagattctcctgctcggtttccgactatttcggcattttcacccttcactcctgcttacattcatcgcccaccttcatatccatctgctgtctgcccgggaatccgtgttacatctcttttctgccccatttttagttttccttccctgccaaatcagtgctcatgagagttactgtttgccatttgctgtgctaaggttcagggactgttgttatttctctctcaccctctgacccattatactgctgaggaaattggggtgcagagaagttaagggacttccttaaggtcacatagctagtaagcgcaacaggcagaactatagcattctagaactcttggtcttagccacagctccatattgctaccaccaccctcccccattccccttcccttccagaattcactttgctcctctagctcctgctttctagtccatggccacgttaccattactgtattcactttatatcacaatcagtaattgtacaagtttgatgcttcaaagaggttattgtaccaaacattgtgctaagcactttatatacatcgttttatttaactcttataataatcttgcgagttacgtgctaatatccccatcttacaaatgaggaaataaatatttggaggggaaattattccctaggaaatgcttaacagtgtctttataacctttgtctatgtgtaggtggggttaatcatgacatatgtagactgattttgtatcatagctgtaaatttgtgggtaatgagcagatgaattcaacatgtttgtggaagcagaggtttgtgatggaaactatctgctttgtccataggattttgggtggcaggaggactgagtgatcagattagtttcgttagtggtgaccccgacttccactcaaaattaattactcctttttctgtactactggcaccttacatgtacttctgtcattgagtcagacttaatttctttctttctttcttttttttgagctggagtttcactcttgtcgcccaggctggagtgcaatggcacgatctcggcgcactacaacctctgcctcctgggttcaagcgagtctcctgcttcagcctcctgagtagctgggattacaggtgcccgccacctcacctggctgatttttttttgtatttttagtagagccggggtttcgccatgttggacaggctggtctcgaacacctgacctcaggtgatccaccctcctcagcctcccaaagtgttgggattacaggcgtgagccacggtgcccagcccagacttgatttctttaagggcagggcctgttgcttactgtttccacccctagtgcctggcctagtgcgtggtatgtagtaaacacttggtaaatgttggtggaactgaaatgtggttttctcttctaggagggcttccttatgaactgactgaaggggacatcatctgtgtgttctcacagtaagtgtcctttcatttcctgcctcctgagtcgacagagtactttgtttctgtaatacattttgtggcatcacaaaaaccacttattttcactctaggctgaatggcatccctgcatggggagggctggagcttctgttctagatcagtcccaggacatggttctagaatgttctgtgggagatccaagaggtttgttaatttgggagggcatcttggggatcctagtctatttctgttgtttttcactgaggcttgttcagcctgggcctagactggaacagactggactccttgggctcttgcaaactaggggtaacccatggtcacagggcccttctggcccttacctgtgtggcgtcatacgattggggcaaagcacagaggaaattggggtaaaaaacagaaggtcgtagtttgctttctttgtttctcgatgagtgtaaggttagtgagcaaaggcaatctctgcctggaggctgagaatcacagcccgaagggaacaagaatgaataggagacctgtatattcttcattctgctgaggtgttagcagcagcatttcatgggagagggtgttggcagctcatactggtagtagcagctggtaggagaggggctgggcagctggcctgcaaccccagagctaaacagcacagttagtccacagggctagaggaccttggcacaggtgcagaggaccactacgtttgggttttgtagtccttggaagcatagtactgtttcagagaagttggacagcatgtacaggtagcggaccatggcaaaaggggctggccaagcgaacaccggtagcatacactggcagagggattgctatgggaccatccatggacagagggccctggccgagtggttgagccacttatggggcagcaagacatgggaaaggaattgggcaatacccgtgagaagaaggctgtgatagagaacctgggcaacccacacaggtggagggccctggcagggacaaagattgcttcctccaacttctggatgttgggaagttcacagcaggtgcagcctataatttctacccctttgtggtacttctactcagccttccatcttggagctgttctacttgcattaagtaatgatgagctaacgtgtgcatgtttgtttattctaattatctattctctattctggttacgcacgttgctctccatgaagattgcctttgccgctgataacagtgcctttcaaaaaactactttgttggctgggtgcggtggctcacgcttgtaatcccagcactttgggaggctgaggtgggcagatcacctgaggtcaggagtttgagaccagcatggccaacatggggaaaccctgtctctactaaaaatacaaaaattagccaggcatggtggtgcgcgcctgtaatcccagctactcgggaggttgaggcaggagaattgcttgaatccgggaggtggaggttgcagtgagccaggattgcgccattgcactccagcctgggggatagagcaagactcccccatctcaaaaaaaaagaaaaaagaaaaaaaaactactttgttttctgattttggaaggtaatacatagtcattatagaacatttggcaaaataaagtataaagaagaaaatagaacatactcttaaggaaaaccttaatgttttggcatatctctttatcatttttaaaaaaatgttggacattatttccaatggtttgctattatgaattatactgcaatgtacattatagtatataaatttttgtatgcatccctcatggtctctttagtgaaagaggaatatggatcaatatgttagcattttaaagatgttttataaacattgccaaattgctctccaaaaggttgtaccaatttccacactcattagaatgcccatttttctgaatcctgattaacagtgactattttaaaaaatatttgccaaagggcttctcattattactttgctttgcctttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcttgacctcgtgatccgcccgcctcggcctcccaaagtgctgggattacaggtgtgagccaccgcgcccggcctgctttgcctttatttcatcatcagtgaggttgaacatctgtttatagatttgcagcccattatttttctttgtaaattgtctattcatatcctttgccaactttcttctacaagtattttccttattttcttgttgattttacatgagcccttcatgtatgaaggatattaactctttgcagtactttgttgtgtattgtattacaggttgaatatcccttatccaaaatgcttggggccaggcacggtggctcacgcctgtaatcctagcacattgggaggccgaggcaggtggattgcctgagctcaggagtttgagaccagcctgggccatatggtgaaaccccatctctactaaaatacaaaaagtagccaggtgtggtggtgggtgcctgtagtcccagctactctggaggccaaggcaggagaatcacttgaatcgggaaggtggaggttgcagtgagctgagatagtaccattgcactccagcctgggcaacagagtgagactctgtctccaaaaaaaaaaaaaaaagaacaaaatgcttgggaccagaggaccagaagtgtttccaatttgtataaatgtaatgatctatcttggggctgggacccagatctaaacataaaattcatttatgtttcatatacaccttatacacatagactgagggtaattttataccctcaatattttcagtaattttgtgtgtgaaacaaagtttgtgtacattgaaccattagaaattaaaggtgtcagatatggaattttccacttgtgataccatgttggtgctcaaaatgtttcagactttggagcattttgaattttggattttcagattagggatgctcagcctgtactatggacttattttttcttaatttgatatgttatacttatcattattctttcttgatgctcaaattttccctatttgagggtcaacatgagttccttcaagccagtgcctgtattctttttttttttttaattcttgttttgaaataatttcaggcttaatacaggaacattatcaaatggcataaagaatacctgtatctccttcacccagatcccccagctgttagcattttaatttagttgattgttctgagaaagggccttgctctgacacccacgctggagtgcagtgttaagaccgtagctcactgtagccttgagctcttgggctactgtcatatgtaatctacagaaaggtagtgttacttccttttttcatttcttgtatctgttttatctaattgcattggcctatacctccaatttagtattaaatagttcctaaacttagttgaattggctctagtatttctcattaagtaggatgctggattttgggctgaagtgtatgtatgtgattatgtaacatatctatcaattcctattttctttttatgactttatttttaaatttataaacctctaacttacctggaatttatctttttgtaaggcgtaaggtagtttgtttttctaatgttttttctttttttttttttgaaacagggtctctcttgctcaggtttggagtgcagtggcatgatcctagctcactgcagcctcgaactcctgggctcaagtgatccgccccacgcaccctcctgaatggctgggactacaggtgcacactatgcctggctaattaaaaaaaattttttttgtagagacaggggtctggccgtattgtccaggctggtctcaaactcctggcatcaagtgatcctatggcctcggcttcccaaagtgctggtattatgcacgtgagccaccgtgcctgatcttttttttctatttcctttttgttttcctatttctatcttcctttttgtttgtttgctttttttagagacagggtcttgttctgttgcccaggctggtctcgaactactggcctcaatcctcctgcctcccaaagtgctggtattacaggtgtgagccaccatgcctggcctttttttttctatttaattctgccttcttgtttgtttgtttgtttgttttagagacaggatcttgttctgttgcccaggctggtcttgaactgctggcctcaaacagccctcccaccttggcctcccaaaatgctgggattacaggcatgagccaccatgccgagcctaatttctgcttttatctctattaactgccatctgctttcattaggtttgctttcttcctttatgttcatcctttctcttcacaataaaattcttttaaaattacaaattttcctgagtatgacgttagccacatttcataagttttggtgtatattctcatttttgctattttctaaatagtctgccatttatttttttttaattttgcttcgtcttctctttcatgctgttgttaggagagtagctttcaagttctagttaggtaacttttttttatttaaaatatcatttccagctttataacattataactggaaacatggtctgttctgttttttgtagtataattattgaggtttacattgagacctaatccatagtcaattttaatacatgcttcatggattcttgaaaatgtcatcttgtaggattcaaagatatctatgtatctaatagtcctacattaatatttgttattataacagagtaattatgtatattaattaatctgattttagtttatttctgtccactttgtgcgtgataaacttcaaagtgatgtgttaaattctcccataactttctctattagtttctttttgcatttcaaatagcttttttaattaaaatttttgatttcttaattggctcataacgttttcctggcttatacctttgttgtgtatttaggcctttttcagtgtaaaataatcttcttagtctcatgtgatatttttattttggccttgaattagtctttgctctggatattgccacccattttttaattgggggttcctgttcttgtctgactttttctttgcaacctttctatgtcatcttgttctagatgcatctcttgtatacactatattatttgaattttgttttattaccttatctgcatgtttttgccttttaagtcaacagtgtcttactcttttataaaataaatagatatggggagattgttaacattaatctcgtgcgggacaagaaaactgggaaatccaaaggattctgtttcctctgctatgaagaccagaggagcacaattctggccgtcgacaattttaatgggatcaaggtgagtgtgcttattaagcaggttggttggacttttttcccatgtataggggtttcgttttctacctggttcccgcagacacaagggcagcacttgtgagcttggtgtgttgcgggggctgcagagatgtggagacactggtcaagaagagattccaggaaataattctgttggctcatggtcctgcaggacttgcttcttttccccatctgttaacaaaccatctccccaggagcataggcaccaggcctgcctctcatccaggcctctgtttttcacctttcttttattgtctactgtcatctctggtgtactggaggatgaagagactagcaaacattgctcttccatattgttgtgtgttgggggttttgggcttcatcatggcctcataatctagtacatagccatgtatgtctgtcatatatctccagtgacctagcatattgggccctagaaattctctagttaaaatctgatggcagattctacaaaagtaatttcatcctgaaattttctccccccagttccctctcatttccactgtcataagtgaggcactgagttcttagaaggagatagcgcaagtcaggcttattgatgctccatgtggttgctgcactcatttaggaaaagagctgcagttgaacagtgtcacagagttggtggggggaggcttgagttggagagtttgtcactgattcacgagtatggaatagctggagattatagaacagagtggaacaaggttctaggcttgatgtttaaggaagccagcagtcagagggcatcactgtaaaaggaaggttttccaaagtgtttcaaaatggagaagaggatacatgacagaagccacttaggccttaaggtaaaaataaaaatctgctcttgtattggaacaataaaagccaaactttaaattttggatgactttgcctagggagtaagtctgtatctgcctaaaaatagaatatttttattttaagtgaggtgttaattttttggggggtgggggagggggacagggtctcactctgttgccctggttggagtgcagtggcgtggtcttggatcaccacaacctctgttgcctgggttcaagtgattctcctgtctcagcctcctgagtagctggaattacaggtgtgcaccaccatgcccggcaaatttttgtatttttagtagagatggggtttcaccatattggccaggctggtctcgtacttctgacctcaagtgatccacccgctttggcctcctaaagtgctgggattacaggtgtgagccactgcgcccggccagaggggttaatattttgttgttgttcatctggagagatgtgattcgttgtgcaagaatcagcgtgagctgattgttccagtatggtggggctagagcaaggtgtgagggcttaagaaaaaagcaagtgcccttttcttgattcctttctccctccaaactattggtctgactttgcctcctaattactgggtggagaaagcagttgtagcattaagctagatttcaagaattccttctagttgccagaccttcctagggtatgtttcactgtaaacttaggttacagatcaagggtgattcattgtgcatctaaatctcagtcttccctgatgcttgtgctttgaggtagttttcctagtctttttcattttatggcacatacagaacatgaagatatttgtatgctgccccagagtaaagtgatgaggctgctggtacaactgccccaggcctcatctggctgcactgagagctgaatgtattaatatttaggtgtacatgctatgacacaccagttggacaggtctgctttagtgacagaatttaacaagaaggtaaaggatgtagttcaaatcatggttctctgtagcttgtgttcaaatagtttgacagtttggtatgagggctgtcttcactgaagcatcgcctgtcttgcttagatcaaaggaagaactatccgagtggatcatgtgtctaactatcgggctcctaaggactcagaagaaatagatgatgtgaccagacaactccaggagaagggctgtggggctcgtaccccctcaccaagtttgtctgagagctctgaagatgaaaaaccaacaaaaaagcacaaaaaaggtaaagcattaagacttaagagaagattctgggtggtcttaatgtctgctcttccttgcattcactgatagttgataatcaactcaagtgtgaaaggggaaggtgtggggaagcatagtttaattgggaaagcagggagtatcagtggaaggctggtgctatgggcagaattgtgtctctccccaagttaatatggtgaaatcctaaccctcagcacctcagaatgcgactgtatttggagataaggtctttgaagaggtaactcaggatgggaattaccttgtacagccactcgacatatcaaaggtgacagacatccaagttggcttctcggaggcactctcctggaggcctagacagtggctgcttcatgctgctgccaaggttgttctccttatgcacattccccacttcctagcatgtgaaagtttctgtcgcccaggctggagtgcagtggcacgatctcggctcactgtaagctccgcctcccgagttcatgccattctcctgcctcagccttctgagtagctgggactagaagcacccgccaccacacccggctaattttttttttttttttttagtagagacggggtttcaccgtgttagccaggatggtcttgatctcctgacctcgtgatccgcctgtcttggcctcccaaagtgctgggattacaggcgtgagccaccgcacccggctgtgaatgtttttgaactgtagcacctgtggttgatgtaacgtattcagaaaagaaaggtgctttttttttttttaagggagttcttttatttttttcccttttcttatttactgcttctttcttttatcctccagacaaaaaggaaaaaaagaaaaaaaagaaagaaaaagagaaagccgaccgggaggtacaggcagagcaaccatcctcttcgtcacccagacgcaagacagtaaaggaaaaggatgacactggccctaagaagcacagcagcaagaactcagagagagctcagaagtcagagcccagggaggggcagaagctccccaaatccaggacggcctactctggtggagcagaggacctagagagggagctgaagaaggagaaacccaagcacgagcacaagtcctcaagcaggagggaggcaagagaagaaaagaccaggattagggacagagggcggagctcagatgcacattctagctggtataatgggcgttctgaagggcgtagttatagaagtagaagtaggagccgagataaatcccataggcataaaagggcccgacgctcccgggagcgggagtcttcgaatcccagtgaccgttggcgtcactgaagacttcagctgcacagtagatttggaaataattatgttttttaaatgcagtcaaattcagttgggtggttactatttttgtatctaaaacttctggggctggattcttttaatcccttgactatttagagtcattgggagggctgcagtttcaacagctagatatcctggatattgtttgcaccatccattgtccctgtaccagagtatgtatcctgaactttggttcataaatatggctcttgaacccatagaccccagttgaagatggaattttcaggaaagggaaaatactagataattctagaattctagtcttcgtgttagatgtttatagcccagcatcttgggacctttccagttactaggtttggacagcttgatgtgaacgaatgggataggatttttaaaatcagccagctccatgcccaaaccttcctgtttgcagaactttttaatgtcttttctttttcattaaaacttttttgttcgatatgcctctttccacattttttccttgcaatgtatttattatttatttgtatttaggtgaaattcacataacataaagttaaccattttaaagggaacaattcagtggcatttggtactgaacatccacagtgttgtgtaaccattgcctctgtctagttccaaaacattttttatcatcccaaaatgaaaccctgtagccattaaacaagagctccccgtttcctccctcctccctgtccctagcaaccaccagtggacttcctgtttatgggtttgcctattctggatctttcataaaaatggaattacacaattgtggccttttgtgtctggcttctttcacttagtgtagtggttttttttttttttttttttttttttttttaaatttgagatggagtctcactctgtcgcccagactggagtgcattggtgcaatctcagctcactgcaacctttgcctcctgggttcaagccattctcctgcctcaacctcctgagtagctgggattacaggcatgcaccaccacacctagcttatttttgtattttagtagagatggggtttcaccgtgttggccaggctggtcttgagctcctgacctcaagtgatctgcctgccttggcctcccaaagttctgggattacaggcgtgtgccaccacacctggcctaatgtagtgtttttgagatccatccacattgtagcatgtatcagtacttcattcctttttatggctgtatcatatcccattgtattgatagagcacattttgtttatgcactcatcagtgagtggacatgtgggttgtttctactttttggctagccagcttcctttttgtattccagacataccaggctaccttttagcctttgtcctcttttcaagtagccactgttggtgggatgggaaccctttgccatcttcattgtctgtcctggtctgcctggcagttccttcttcttttgagttttagctttctcctttatctatcagtctcttaacgagtttggtaggaactaggtcacaggacctttaataaatactccctggtaaattatgaaaggttgaatttctgaccctgcaaaatgaaagaccagagctttaatagtgagtgcactaagttggacttccctttgtgttaatttggaccctcggttagacatgcaggagagttggagagtttgtgggggatgtagtaggggagggtcgaggagtctgggaaagctgtcagactatgatacagatctaacctctggagaagaaataggaaggaggggtgggtaggaaaagtcttgtgcagttctaagatggtttcagctagaccaaagtgagttgagccagagtcacctgtcagaggagccctgctacatcagccatcataagcagttcatgctattgcctcttggcctccatctcagccatcgtggctgctgtgctcatgtgcccattatgccattgctgtggtagccagtgacaaaggcctgtgaaccgggttaagtcatttcgtctgcttgcttttatatgtggcaaggaattggatcacacaattatgagggctggttaggcaagcctaaaattcatgaaacaagagctgacactggtgggatttcttcagggaaatctgttttcctcttgaggctttcaactgattggttgaggcccacccacagtatcaatggtaatcattacttaactgatcgtagatgttaaccaaatctacaaaatccactactcccccgttatcaacgggatatgttccaagacccccagtggatgcctgaaactggctaatgctgaaccctacatatactatgttttttctgtacatatatatgataaagtttaaattataaatgaggtacagtaacaacaataacagtaaaacaacagttataacaatatactgtaataaaagtcatgtgaatgtggtgtttctcaaaatatctcacgtatgtgatattttccgacaacggttaaccacaggtaactgaaaccacagataaggggggattactgtaccttcacagcaacaccgagtagcgtttgattgagcaactgcgtactataacctatgctgagttgacacacaacagtaaccatcacagtttactatcttgtctgtggaggggttcgggggagcagcttcagaggtttccacatggccttcctcactatgacagctctcactccaacagactaaggagccttttccacatggccttcctcactatgacagctctcactccaatagaccaaggagccctgggggcattcattactcctactgccaggtcaattccagttacacacttagggctaggaaatgaccactggctgggtcagcagcaggcccaccgtgaatcctgttttggccagaatttcagttatcacttggcctccataagcccccagtctaaccagggccgtgatgatgcttcctgtctctaggtatcagtcaacttagatcttgggtccagtgttccgccaaatgtttgagtattctctccccagtgtacatatacccaagtaagtggctgtaggtccctttggggaagtactgggcaaatcattacatactaaccattgtccttcccagggatccagccacctctttccagacctgaaaactggctgaagtatggcagctaagcaagaaagtaggactttttattggggcaagctcccttagcctcctgctcctccactcctcttcagcttgtagatagggagcaacacgctttttgacttgctcctagggacaccatgttccattagccatctccagaactccctgaaggtaaagcccccatggctgtccttcagaccttgtggttcgctctggtatttgtggcctcctgccttctggaggttaagcacttctgtctggtgtctcttactctggggccccatcatcccctttgacactgatgagcacagctctgtgatggtctctcactgtcagccttggcgtgcagaggtggccacctctgaacttaatgatgctggtgtccctctcaccagtgccttcctgctgacctcagtgcatgaggtctcccctgcccccccatggaatactgtcttctggtgggcttttgacttcatgtaatctgtccaccccagcatgcccacttcccttcattccttcctctgccatctgccagggcagcttaggtgtttctacttggcccagcattggccatcgctttcactgggcctttgagatccatcttattagaggctgctcacccgctgtgggccttgccaggaggttaaattgtatatcctgagaaagggctcccaagtctgaagttttgcttttctggctctcttgatatagtacctgtgaaatccaaacccaatacttccttgacttctgctagcctatgccagctaatttttgcagctctttggtgtatgttccctcctttattagggccagtactttcttagccagtttctgctgggattaaaccctagttaccagtttagtaaccagagagagaaagagaggggctggggacagctgtgagtgaggcactggttgcctagtgtggggagcagcgtctgcagcatcttctggcacaggggaagtgctagctcttagtagggaagcgtgggcccctctgcaaactgacagttgaaccagtgtgtttgcagagccagcaccctcagaggcatctgccagatgttcccatcccaagtctttccaaccacatgaagtcttgtggccctgacttcagcagaacggatctgctatgtgataaatattgaccgttacatctctctggacttgggcaacttgatcacatcttctctttggcttagccatatccattcctccactgcaggagatcagggcctctttgtaagctccatggaagccctttggctctcatgaaacagcgtttagttgcttgttaactgtcacccatttctcattacctgttgcagggcatcaagacaatttaataatactcttaagttatctagccatttccactgtctttgcaggccttatccctcccagattttcaaaagtctgagccaggatacctgcaaggccattctcccagttttcccaggttatctccacagacatctttagcagttggactaccaccctgtgccagtgtccattttaccaagcaggcagcgaagccatcccagaaccccatctcgccattgcctgtattcttggaccaccaccaggaccattcatgttagtttgggttctctgaaaggcagatgccaagatgagattagatgtatgagagatttaccaggggaaactcccatagggaaaatggggagggagtcagagagagcctagatagatgcacatctaacccctgtggaggacagagagaaggaagggtgggtaggaaaagtcttagactacggggtgcagttctcaaatttgtttttatttcgtttcattgtaaattgacaaattataattgtacgtatggggtacaaaatgatgttacgatttatgaatcataacaccatttgtggaatgaatacatcaagccaatattcaagtgatgcagttctaaggaggtttcagcaaaacaaatgtgtttctcaggagggacggttcaccacgggccctgagtgcccctgcacgttcttggcgagtatcttaaactaatgcggaaccattgctgcagatagtcactgtaaggaatttaaaattgtattagtcttgttcagactgctatgtaacagatattgactgttacatctccctggacttgggcaacttgatcacatcttctctttggctcagccatatctattcctccactgcaggcttcagaagcaatggtaggcctgtgaccaacaaatgaccccatgtgggctatgagcctacatggagaacaaacacccactagtcctgagaaacttcagataagaaagggagtatgctgtggaacttctcaaacctcgagaatctggccagttctctaggtttcagaacatcctgagacacacaaagtaaaaccttaagcattattgattaaactttcagagctgcacatttgcacgttagctgttaattttagctagggtgagcaacacccttgttgactattgctcctagggacaccatgttccattaaccatccccagaactccctgaaggtaaagcccccgtggctgtccttcagaccttgtggttcgctctggtaatataagctgggaccctccaattgctctctgaagtctcacccatggagtggacacactgccggggacctgttccaactaggactccagatgtctgtatccaggacttcccagcactgcttgatctgggtgtaggtattctccccagtttgttgaaaaaaaaaacaaacaaaaaaacccgtattttccttttacttttcccttttctcctactttagcttttgctaagttaactattatactcttttgttatgttgatcattaaactttgaactgcatttgagtgtaatattgcagtttcttttgctcgtgaatcctcaaacccaaaatgatgaaagtaaaactttcagcaaaacagtcacataggcaaccaagtagggcaaggtgaccacagtctgactactatttaactgctcacttcccaggggaggggcattggccactttgctcattacccaaaaagtcctgagccccttgatcctaggttcctcagctgtgattcaactgcctgtatgcgtagcgtccatctgagcctgttgcattgtcccgtggcacttgggggcaggggaactggaaaaaccatactgatgctcatgttgcttgctgtgttgtaataaactgtcttgtttgaacccattaaatttcactgtctatgttctacacctatgatgaagaaatggcaggtttttttctggtcattctctatgagatgggggctcttccttgacagcatccctgacccaaagtcatgcgttaggggagtcctttgcttcatagaaatggcctgacttagtgtctctgccacaccaggagatgcctgtagaaagtttggttttggtgaaaatgcagtgatgcatggtgagtttcagccactttggatttcagctgcagtagtgttgaatttcagagctcagtggtcagctacgctccctgcagtcagaggtctgaggggcacagatatatcttgctctaggcccagcctgaaacaactcactagtcattgactttaattaacctttgggaactgtgaatgtttacttgttcctttcatgagttgacttcacagaggacatttggaattcattagtggacaaattgctagtgacctcaaacctaaacagccacattgagtgaagtgctcatgaagaatgctttttagtttttagcatatcaatatttttttttgatgtggcctaattaacacctgaatctgtcagtctctttttttgtttgtttttgtttttgttttctgcttcctctaacgtattgagacatgtacctagtaagtacctgtcttggtagtttatggactcatgaatcctaagttggaaataatccttatctggtacaggccattccttctgcaaacatgttttgaagctctttgaaagaagtaacgtggtcatcatctaaatgggtattctaatgaagtggaaagtgctccccatggtgctgttatgaccaaagaataaagtcaagcatttcctggtgtcttttatctgaaaatgtaaacttagaagatataatttgaggagtgactatttgcactatgaatgatttaacctagacttcttcctcaactcaataagtggcccctgagttttgcaagtgttactggaaacagcacaaaatagatgataagagcaggtcatatttttcaacaggaaataatgaacaattacatttgtgataagcatttggtattctatagctgaaggatgatcaatagtaagtcatcaaagatacattggtccctagatggatcattcaaaatactgaagttatgtgtcaggggctataaagtggcaaaaccataggacacatgtgaattgtgttactctaaactatatgcttgtcatacagatgtatagccattgggatgtatatttaatctcaaaacaattcgctctctaaaatgaacatcagtcaaaaatttggttcctttttgttggcttagaatttaaaagattactttggggatgattgaagatgacctagcctctttaaagaagctgttcaaagaagcctgaatgaatgttttctttttttaaaaaatttttatttccataggtttttgggaaacaggtcgtatttggttacatgagtaagttctttagtggtgatttgtgagattttggtgcatccatcacctgagcagtacacactgaacccaatttgcagtcttttattccacatcccccttccaccctttcctctgagtcccccaagtccattgtatcattcttacgcctttgcatcctcatagcttagctcccacttacaagtgagaacttaggatgtttggttttccattgctgagttacttcacttagaataatagtctccagttccatccaggctgctgcaaatgccattaattcgttcctttttatggctgagtagtattccatcatatgtatatatatatctctctcgcagtttctttatccactcgttgattgatgggcatttgggctggttccatatttttgcaattgcgaattgtgctgctataaatatgcgtgtgcaagtatctttttcgtataatgacttcttttcctctgggttttttctcatgcctcatgtgaacctgaggcatttgatgtcattccattcactttaggctgggattaggatttgtttaagaaatgatattggtgatgatgataatatttctttgagaggaaggcatttatttacaagcagctaatcacaacagcaaaaaaccttcatgattattaacttaaatacctaagtttgttaggttttcattagtataccatatgattgttaaatgataaagtatactgtgtaattgttatcagagtgaacatcttactttgtgtgctgttttcacttatacatgcatttctatgtgttcatattatcactgtccttgtgattttcagttgctatgtagtattcttttctgctgatacaccacacctgtctcccacttggattgttttacttttttttacaattaatagtactgctatgaacattttaatattgacccccttaaaaatttttcatttcctttaaggtttccttggactgtgttctctaaagtagagttaccaggtccaaaagtgcagatataaccctaccttgtcttacttgctgtcagattgcttttcagaaagatcaaatttttaaaaccaccatcactgtagagttcaagtgtaattctttctgtacattcctggatttgatcattttattattttttgcttctcagaaagatatattgtgataccttcaatttattctaatttacattttctttcatggcaggtgaagctgtctgtgcatttttactatagtctattttttaaattttttctttttctttcttttttcttttttgagatggagtttcactcttgttgcccaggctggagtgcagcggcgcgatctctgctcactgcaacctccacctcctgggttcaagggattctcctggctcagcctcccgagtagctgggattacaggcgtgagccaccacgcccggctaattttgtatttttagtggagatgggatttgaccatgttggccagtctggtcttgaactcctaacctcaggtgatccacctgcctcggcctcccaaagtgctgggattacaggcgtgaaccaccacgcctggccagctggtgcaggttttgatttgctctttgtgattacttgactttggtgttctagatgaggcctatcctctctccatcaattggattttgccaagtgcagggcaacaggtatgaccgaaaagcatgagctctccactagccatatcagtgctgcaggtgtctcgaaggggtcaagaggattcctggaggcttgaaagcccctcggagaagtcagatctttgcaccaccctagatgttcagggatatatcttggaaatgaactattagggaacccctaaagctcacctgaattggcttgtactcacgaagccatgtactaactagacctgcactatctaataagggagtccctagccacatatggctatttaaatgggaataaattaaaatgaaaaatccagttccttaatcacactagtgactcaatagccacacgttgcttgtgactactgtactcaactgtgcatatatagtccaatcccattatcacagaacattccatcaaacagcactgaactggaccatttacacatgatgggattgtatgtagctatgtaatccattgtgaaaacctctctggatctttctatgcccctctaaaccctacttgtcctttgagggttggctcaattctagttctcccaggaaacatctcctgaccactccagctcacagcaatgactccattcttggaaccccccagagcaggggtccccaactccactggtctgtggcctgttaggaactgggccacacagcaggacatgagcagcagggcgagcaagcattaccacctgagctctgcctcctgtgagatcaactgtggcattagattctcatagggagctcaaaccctattgtgaactgtgcacatgagggatctaggttgcgtgctccttatgagaatctaatgcctgatgatctgaagtggaacagtttcaccctagaatccatccccaccctaccccacccccatttgtggaaaaattgtcttccatgaaaccagtccctggtgccaaaaaggttggggactgcagccctagagcacccaaaatacttgacacactgtcttattggtgtcatacttttgcttgtcagttagtcttatcttcctaagaaggctacagggacctcaagagaagagcttaaatcacacactgcctgggttcctcttctcatgccagaatgcatagcagaaacatttatcaaactctctttttttctagctgtcttctgtactttgctcttgttttcagtatttagaagaatcagcatgtacgacaccatgtcatgcttcaaaaaccatatatttttagaggaaggtcagcatgcttattgatgtcaggtgtagcacttcagcttctgtcttggtgaggtggcaggagtggggataggattgaggaagatttgggaaaattggtattagatcttgaaaacacctttgacagagcaaagaaaaatgataccttcttttgtaatttcaaagctctgtttgaaagtactgggcttagcatctatgaacgcaccaaaaggggtatggacatttatttgactttctaattgaggctgtcatgctaggggattgatagtttaggactcagaaagaagcatttctagaataacttatagttttgtggtttttttttttttttttttttgagacagagtctctctctgtcacccaggccagatgcagtggcaggatagctcactgcaacctctgcctcctgggttcaagcaattctcctgcctcaacctcctgagtagatgggactacaggcctgtgccatcatgcccactaatttttgtatttttttttttttagtagagacagggtttccccatgttgtccagactggtcttgaactcctgacctaaagtgatctacccggcttgatctcccaaagtgctgggattataggcatgagccaccgtgcccggccaaataacttacagtttttaaagcactgtcacaaagagtctttatttgctccttttcacacctctggggaggaagcaggagaggtcagtgaggtcagacacctcatctaaggattatatgggtaaaaagtagctaagttggcactaggaccagctctgcactccctgaatcctgatgcttcttgagccagctttgcagagcctgcctccctcgtcctagcagataactgtgtgaaaaaacttaacaagctaatttcacatgaaaaggtaaatttcaattcaagtgccaggttcatttcagaatgtccaggtgaaagcagcagagcattttaaaatgacatcagttctcacccactttgggtaaactttcagttgactggccccaacagatctgtttgttgtgtgagctataaaggacttgtgtggccaataacagtctccatttggacccattttttctgcaccacttgttttgtgcatagggcctttaaaacatatcctagttcatggtaacaaaatgattattgtatctgtaagggcagaaatgaacatttatctacattgctgatgcatcaagacaggatgtgatagcacatgaaaaaaaaaacaggggcataaaacacatactttcttatttccagtaaaagattaaattctcttatacctcttgtggttacctggtttttatcttctccagcaatataaccttgggaacctcaagaatctagggcttaaactaaggtagcagagagcaaatttacccttaagcaaagggggaaaatttagctttcaaattaataatgcagtactagaatatgctggtagttttaaaaactagctagagtgacctagaagttcactctaaggaaaacgccaaaatttgcagggacaaagacgaggacttgaagggagagatgggtatctgaaaaagcaagataaagacttttagttacagtattgaggtgtgtgctgcaaggccatattctggagatctcataggaggagaagattgaagctttggttttgaaatttggtgatgttgctaaaaatgtggatgcctagattctgtttcgtggaggtgctgactgggcaggtctgcagaggggccatgattctgcatcattaataagcaccctgagtgatcgtgatgcaaacagtcctggacgacactttgagactctgcctccaagttgcagtcactattagattctgcatgttgctcaagatcggcagatgactggtatcctaggatcacagcacacaggaagctcattctgagcagtgcagtgaaccctttggctaccaattcatacttttttccaaagtaaaactgctgaaaagacaaactgggcagtaggtatggcattcatagtgtgtaggaagtaggagagttcaaatgaagccagcttggtgagaccaattctctttccaaaagcaaaccctggaggattcaacagcttaacacagataccctgatgctgctttcatcagcttgtgggcagagtagtgaggttcatttggtcactgtgaagggagacgtgcctggggtgtttatggccaaagtaaatgggccatagtgcatgctaagtgctagggaattacacttcatactgtgaactgatttacattcccagtaaaactgtatttgtaaaaaaatgcatcataagctgtaatggatatgtgctagtccagaagtcctctttttattgtgaattttcttaaataggcatcattgtaatttttagtaagctctcctttgtggaccttctttctattttgagcatcttagcacaagtttggccatttgtgcatttctccctccaaaaggaagcagcatcagggtatctatgtcaagctgttgaatcctccatggtttgcttttgccttatcagagaaaaaataagttatctgaattgacgactgctgtgcagtgagttcctgtattggaccgaatgtagcggttggaaggaggtgtttctgctcaactaaaggtacagaagaatgtgcttttactacttggttgggcatgcggttggaaacctacatgggatattttttgcttgccactgtactctgcagactgtccttggtcactgcccaattctgggatacagtggcaactggaggtagccccgggctggcggaaagaaattgtatgggatgaaagtcacaagccctgtgaggtttgagccccagcgcagccgtttgttggctgtgcaacctcaggcaggtcatttccctccattttctcttctgtaaaataggacataagactcgtggaggaagcacagtatggtaggctatttctctttcgtgactccgttttctctttaataaaatagagatgacgctctgcagggcagatgtgagaaaagcacattctcagcagaatgtctggtacatagccgctgcttaataaatgttacttccaatacctgctacccctctgctgtgaggtgcaagtcagagagctgcatactaacctgcaaattgcaatctatatgcacaataagtcatctgtttcaaccccatgctggtggcagatgggggtgtgcaaggcaggagcccctcattccaggggggtgagtagacaggcatttatatccaaaatgacgtcactgagcgctggattataaaatgatatatattttgtacctgaaatgtcattatttgaagactatgcattggcgagaatgcttttgcattgaaagagggtgatgaactgcccggacaaaagtgaaatacttatcgtaggcccctgccctttgatggatagtgaacaacagaaatacctagaaaccctcaaaggatgaaaccactgtggcattgtacccagtaatctctgccctctgctcttcctgggcttgagttctcataattctggtcaattatgaccacccaggattggccccagacttggatgtggaccttggctgcccttgtaggatcatagcaaaagctcagttgtcccaggtcacaaaaaatgtcagccatgtctgcctctccctcctgggacttggaataaataaaacatgatgggtccttctccaagcgaagataatgttagcaggggtctggcggggagaagggggaaagggctgtctattttatcaccctgatctccttttcaagaattctcagcaattgtgcggtctggagcaagaaagtggcaggtggggtcgcagaagcacagagttgatgttgaggcgggcttagcccctggctttcctctggatctttatcaatttattccctcttggaacacagaggcagcatggtcccagaaggagacaaaataggctggggtgggtggcggggttacagggtagccactccatggtggtggcagttcaaaaggaagtggaaaatcaatgaaataaggcctaaatacacatgaggtgagagaagcgtgttttgtattgattgtgtggagagcagagtattatctcaagagtttgactctggttcttccgagaggatttgaggcagcttatgaattaagacgttgcaaagcagggtacttaaatggataaactgggacagggacaatggaaagcacttgttcttaaccctggctgcacagtagaaccaccgggagaaattttaaaaatatgcatgcttgggcttcactccagttgaacaggaatccctgagtgtgggacaagtattggtatatttttaaaattccccaggtgcctctaatgtgcagccaggttgagaagctggaggagcagatgctaccaaatccctgacatgagtagattaagtcagtggttcgcaacattggctgtatattcaaatcacccggagagcttttaaaatcccatcgcctaggctgcaacccagaccaactgaatccgaatctctggcgagagtcgggggagcgggcaggcatcagttgtttttaaagtttgccagatgatttcgatgtgcagcccgggttaaaaagctctgctctgtggccgggcacggtggctcacgcctgtaatcccagcactttgggaggctgaggcgggcggatcatgaggtcaggagatcgagaccatcctggctaacacagtgaaaccccatctctaccaaaaaatacaaaaaaattggctgggcgtggtggtgggtgcctgtagtcccagctactcgggaggctgaggcaggagaatggtgtgaacccgggaggcggagcttgcagtgagccgagatggcgccactgcactccagcctgggcaacagagtgagactccatctcaaaaaaaaaaaaaaaaaaaaaaaaaaaagctctgctctgtgtagtggttcccaaacatggctatacagtagattcacagggagacgcatttaggaactcctaacatagagactaaatttgactctgatggctaaagcattagtccattcaacaaatgtttgttgagcatctactaaatgtcagtcactatgttaggtgctggggatgtggttatgaacaaaacagacaaagcccttgctttcatgaagtgcatatatatacaaggaaatatcatctaccaggggatgagggcgggaatttttgtctgctttgataactgctgaatctccagtgcctggcacatagcaggctcctgataaacaactgttgaatgaatgaatactgactgaagggtgaattaagtgctatgaagaaaagttacagtgggataaggggatagtgtgtgtgtgtgcacgtgcgtgcacgcacctattttaacatggggtgctcagggaaggcctcactgagaaggtggcttttgagcgaggcccaaaggagaggagggagcaagctgcacagctatctgaaggcacagagttcctggcagaagaagagcaagtgcaaagaccctgaggtgggaacatgttggcacgttagagcagcagtaaggaggccagtgtagctgcagtagagtgacaacagagaggtaatggtgggaggggagagggtgggcagctcatgtagggcttggtagaccatggtcagggctttggcattaatggaaacaccacggcctctttttctgtgtctgacactggagaacatatgtattcatatatggagagaatactattttcctggagtgaaatgccagcagaaatgtctatgctactccataaaggctgctgagtatcttaatgaacaagacctccacagcatggaagtggacccaaggggttgccgctgctggctcgggtggcctgcttattcccttattttgccccacccacatcctgctgattggtccattttacagagagctgattggtccgttttacagagtgctgattggtccgttttgacagagtgctgattggtgcgtttacaaaccttcagctagacacagagtgctgattggtgcatttacaaacctttaggtagacacagagcactgattggtgcatttacaatccttcagctagacagaaaagttctctaagtcaccacctgactcagaagcccagccagcttcacctctcagcatcagctctcattggaaacttcccaagagggcttagggaagggggtttctagggatcacacctaggactggccactcttttggagagctgcgtagaaagggtcagtccccagggacattgggaagtagttggaatcaacactcatttcccccagcagtgccccttcctctctgaagcatctgttccctctctgcctgttcttccaggcctcacctggtctacctgggagtgccatgtaacacactttcttcggattttttgccagaggctccaggaacagagctaattggtgggggaggggactgtgttaagatgttaagaggcaatcgtggcttactctgcacttggacaaggacaatgactcaactcaaaggtgaagactttgatgaaggggttttcgggccccaggagccagccccagtggaagagatttggccccaggaaggtgtgaacaagggagagcttcttgaggccccacacagcacaccacacaagcggtttcctttattttatattggcaaccaggccatttctttcagggccccactgcattgcactgaggggccagcagaaaagacttaccttcatggagcttgcattctctggatctagatctgtaagactttctgtgatcaagcacaatattggaaagcagttacttctgagacatgtatatattattggcacaaaaataatctcaatacttttattattaaagaatcagaaattaagcaaacagtaaaagctgaaagaggtgagatccctagaatgctgggcacagatcttggctctttcctcagaccctgggaaagatggtaccctgggatagatggtgtgttgttatgagaaaaacgggactgtaatggatccccaaactgggagggaactgagagaccaaagaatgactcagataagtccagcttgacaagcagatgagtttattaggacttacctacagtgcgctcctgggcagcagcaggacaactccagagatccaccccatcccccatctctgagctgctttgaagctaatattatggctctttgcctactgtgtatgtgcaacgagactgttttccttggtaggttctcagatactccacaggatgttggggtctcaggcacctgctcctcagctgggcaccgtggccttggctcactgccagccttcaggtttcaagcagcggatatagacccttaagtaacctggtgggggacccgtaacactacaagtatgacatggtggaaggagcaccagccagagtgccaagagagacaggctttgcaaccagctgcccatccttgcacaaccattcatattctgtgggcctctttgctcatctgtaaaatgggagattaggctgtgcatggtttctaataacccctacaatgttctggttgtagacagtttttttttttttttaaaaaagaacgagtcttctaggtaaaggaatgacagaggggaaggtgccagtcacagggaatagtgacttcctgtgaaatatggagagtgctgaggcaccaccctgagtcccagaaaatgtcaatatgccagtgactgaaattcagactgaggagatagaaatgacagtgagagacatttcaaaaagatccacagctaatagtaaaaatagccctggacttcacttcgcttcactacttagagctgggtgaacacttgagagttattaacttctcggacactgtttcttcagctgtaaaatggggatgtgaccattttctcaagaggaccagatgaaatcatgtgtatgtatttgatatacattttgtaaatgtataaagggcaaggaagggaggactcctgctagattactctttgggtcaagagttctagaaaaaaaaaaaaaacagaaaacctcagttacccggaatacgaagatctcattagttgaattgtttgatgaaattggttaaccagaatatcctctaacctctaaattttattatttgttgctagttgttctacagtgtctcaatgtactttcttcttcttcttcttcttcttttttttttttttttgagacggagtcttgctctgtcgccaggctggagtgcagtggcatgatcttggctcactgcaacctccgcctcccgggttcaagtgatttctcctgcctcaggctcctgagtagctggtagtacaggcacacaccaccacgcccggctaatttttgtattttcagtagagacggggtttcaccatattgtccacaatggtctcgatctcttgaccttgtgatccacccgccttggcctcccgaagtgctgggattacaggcatgagccatcgcgcccagcctaaagtgtctgaatgtactttcttaccttaggaagtcttgtacactgcacatatttgaactaacattttctgatgattgaggccatgtgaatttatcagggccatcattccaaatatcagtttttaatgtgtgtaggctaaatgcataccaacccatcgggatatacctaggaagttgttttgaggaagagggcacagaagaattccaggtatttaagagccctagataaactgattcaagttaagattttatgatttattctgtgaaactaagaattcgtatcaccagccctgacctccgcactgaatgtagacttaaatagccaatgacttgggtgatctctccacttgaacgtctgatgggcctctcaatctcaacagagcccaaacagagttcttgtctgcaacgctcttctccacctttgctcctctcagagtctttcctgtttcaccaaatggcaccaccagccagccattcagttactcaagtcaaaattgtaggaatcatcttgattattctttcttcctcacctccaacattcagtccatcatcagattctgctgactccactttcaaaacatattctgaatttgtactgcctccactgctacctgctagtccaagccacagtcatctctctggttggcttgttgtaatagccttctaactggtatccctgctttaatcctatccctactcagtttattctcccacttggagcaagagtaagtttttttttttttttttttttttttgagatggagtttcgctcttgttgcccaggctggcgtgcaatggagcaatctcggctcactgcaaccttcgcctcctgggttcaagcaattctcctacctcagcctcctgagtagctgggattacaggcatgcatcaccacgcctggctaatttttttttttttttgtctttttagtagatacggggtttctccatgttggtcaggctggtcttgaactcccgacctcaggtgatctgcccgcctcggcctcccaaagtgctgggattacaggcatgagccaccgcacccacccaagagagatttaaaaaaaatattaataagtgatagattatgtcacttctttgcttaaaatcctccacaggctttctactgtgaccaggaaagtgctccacactcctttccatggcctacaacagaccctgtgtgatctggccctgaccatctctcttgccaggtgctgttcactgtcctctggacatggcctttcttctcatcctagggtctttgcacttgttgcatcctgtgcttggtcccctctgcttcctgtggctccctccttcttatcattaaggtcagatgttcctggacttcttggaccaaacaaatgaatctagctagtccctctctatcatgtttactcttctttttttttcatattcatttatgaatcccacaaatatttactagcacctactatgtgcctattttctttctttctttctctttttctttttctttctttctttctttctttctctttctttctccttccttccttccttctctctctctctctctctccctccctcccctccctcctttctttcctttcctttctttttcttttcttctttctccttttctttctttctttctttctttctttctttctttctttctttctttctttctttctttctttctttctttcagatggagtcttgctctgtcaaacaggctggagtgcagtggtgctatcttggctcactgcatcctctgcctcccaggttctagcgattctcctgcctcagcctcccaagtagctgggactacaggtgcatgccaccacacccagctaattttttttttctaatattagtagagacggggtttcacttgtgttgcccaggctggtctcgaactcctgagctcaggcaatccacccacctcgggccctcaaagtgctcatgagccaccgcgcctggcttatgtgcctattttctaggtatgtgagcatacagtgaacagacaaaaatcgctgccctcatggagctaacattctagggaagggagatagccaataaacaaataataaatatctatagtctatcagatggtataagagctagggggaaaattaaggcaggggtggaaggtatggagtgctgggatggcagtgaggttgcaattataaagaggatactcagggaagccttcacttagataatatttgagcaaagatctgaaggaggtgaggtgtgagttatgcagatctctgggaggatgctgcaggcagcctagcaagtgccacgactctgaaaggagaatgcctgacatgtttaaggtcagtgtggctggagtgtagtgattaagaggaggtgggcacagagatcatagagggggagtggtgtccagaccatctggggatgtataagccattgtaagggctctggcttttaccctaggtgagatgggaagtacttattcctatctagagttatatgtttatggccccctgcccccacccctccaccacacgttagaatgtaaaactcgtggaaggcaagaactttatctgtcttattcaccactgtatccctagcacttagaacagtgttcagcacaaagaaagtgctcagggaacatttgttgaatgaattgtgcaggcgcaatattaccaaaggatataggaactaggcatgacctagtttaagcaatgaagttggagaaaacactgacattggattcaggttgacttatactctgactcactgtatgaccttggacaagtcacctcctcaccctgaacttcagtttcttcatctccaaaataaaggggttttaccagatgattttttttatttccataggtttttggaaaacaggtggtgtttggttatatgaataagttcttgagtggtgatttctgagattttgttgcagccatcacctgagcagtatacactacccaatgtgtggtcttttatccctcacccccttctttctgactgtcatagcctgtaattctacaacgcaggaaatacatcagtgatatatgaccttctgactatgatatgttcaggaattctggtatacttaccactattctatggttcatcttttaatgaatgttgtttatacttctgggtggagaggatagttttcttaactccttgagtgggttgtaggctcagaatagtccaggtcacctctagccctgtggtttgtatttcaactctgcctttccagtaaacatgacactcctacttctagtccagtgtgacagccatattgatcctgaggagcaaaaccttaagtcgtaaatattttaatgagccagttctaacagagacaaaaaataaagtgggatctatcctagctaggttttaaagtaagcaaataaatttaggtttaatctttagcttcaaaagcttttttatatattttaatagggcaaagctagttatataaagcaaatatacactcttaaaaagatgattaaatcctagtagcattggctctggtccccatataaacgaccaatgtgacaaacccttattttctagatctcagagaagcacagtaattgtaaactcatatcacatcagatactctacactcaaatcattaataaaatctcagtagtgactcagacaaagcaaactaattggttcctgttaactagttaactgatgcagtactcccctaaagtaggtcaatctactggaaaacccagtattaacttcaggtttgacaacaggaagattcatccgtgtaatgaacagtctccttttaaatactatcgaatttaaatgaagaaaaataagtcaatcaagtcttctgttactttggcacttggatctggggaatgatcatcatcaccactaaatatgaaaggtaaaagacatttcatttttctatgcattttacacatgaagggatactggttaagccaaagagaaatctgccaaagtcattatgcatacagaagcaaacctggaatgatgtgtctgagttctcaaatcaagtgaaaatcattgctacattgacttttgtttagtcttactttttatttaaaaaattttttttaaatttcaacttttattttgggttcagggggcacatatgcaggtttgttacattggtatattgtatgatgctgaagttgtgtataattgatcctgttagagaaatgcaaatcaaaaccacaatgagataccatctcacaccagtcagaatggctattttgttaatttttaatttttgtgggttaatagcaggtgcatatatttatggggtacatgagatattgatatctttgatacagttatacaaagcataataatcacatgagggtaaatggggtatccattgccctcaagcatttatcctttctttgtgttacaaattatccatttatactcttttagttattttatttaatttattttttttgagacagagtccagctctgttacccaggctggagtgcaatggtgtgatctcggctcactgcaacctccgcctccagggttcaaatgattcttttgcttcaacctcccgagtagctgggattacaggcgcatgccaccacgcctggctaatttttatatttttagtagagacagggtttcaccatgttggccaggctggtctcgaattcctgacctcaagtgatccacttgcctcagcctccgaaagtgctgggattacaggcgtgagccaccgtgcctggtcatcttttagttattttaaaatgtacaataaattattgttgactatagtcactccgttgtactattaaatactagatcttattcattctatctaactttatttttgtatccattaaccataccccttcctcacccttccacactaacattcatggcttctggtaaccattgttctactctatatctccataagttaaattctattaatttttagcttccacaaataagtgaaaacatgtgaagtttgtttttctgtggctggtttacttcacttaacataatgacctccagttcaatacatgttgttgcaaatgacaggatctcattcctttttatggctgaatagtagacaattgtgtatatgaaacacattgcctttctctttttgtcttaagtgaaaaattttaaatttaactttcttggccgggcgtggtggctcatgcctgtaatcccagcactttgggaagctgaggcaggcggatcacttgaggtcaggagttcaagaccagcctggccagcatgacaaaccccgtctctactaaaaatacaaaaattacccaagcatggtggcatgtgcctgtagtcctggctgctcaggaggctgaggcaggagagtcgcttgaaccctggaggtggaggttgatgagatcacaccactgcacttcagcctgggtgacagagcaagactctctcaaaaaaaaaattttttttcttttctttttttacattctaacttttactttaggttcaggggggtacatgtgcaggtttgttacataggtaaattgtgtgtctcatggatttgatgtacagattatttcgtgactcaggtaataagcacagtacccagcgggtagttttttgatcctcatcctcctctcaccctccacccttgagtaggccctggtgtctgttgttctcttctttgtgtccatgtgtactcagtgttttgctcccacttataagtgagaacatgtggtatttggttttcttttcttgcattaattcgcttaggataatagcctccaactatatctttgttgctgcaaaggacacaatttcattcttccttatagctgcatagtattccatggtgtatatgtaccacattttttttcatccaatctaccgttgatgggcatttaggctgattccatgtctttgttattgtgaatagtgctgcgatggacatatgtgtgcatgtgtctttatggcagaacaatttatattcctttgggtatatacacaatcatgcgattgctgggtcaaatggtagttctgttttaagttctttcagaaattgtcaaactgcttttcacactggctgaactaatccacattcccacaggccgtgtaaaagtgttcctttttctctacaaccttgccagtatctgttattttttgactttttaataatagccattctgactggtgtgggatggtatctcattgtggttttcatttatatttctctaatgattagtgatgctgagtattttttcatatgcttgttggctgcttttatgtcttcttttgagaagtgtctgttcatggtcctttgcccatttctttaatgggtgaaccacatattctttatccattcatctgttgatggacatttagggtgcttccaaatcttggctattgtgaataatgccgcaatagacaaaagagtgcagatatcatcactttgatatattaatttcctttcttttgtatatagtgagattgctgggtcatatggtagctccatttttagtgttttgaggaaccaccaaactgttctccatagtagttgtactaacttacattcccacaaacggtgtatgagggttcccttttctccacatccttggatgcctatcttttggatataagtcattttaactggagtgagatgatatctcattgtagttttgatttgcacttctctgatgatcagtgatgtggaggaccttctcatatgcctgtttgctatttgtgtatgttttcttttgagaaatatctgttcagatcttttgcccatttttttgattggatgattatgttttttcctatagaattgtttgagctccttgcatattctggttattaatcccttgtcatatgggtgttttgcaaatattttctcccattctgtgagtggtctcatcactttgttgattgtatcctttgctgtgcagaagctttttaacttgatgtgatcccatttctccagttttcttttggttgcctgtgcttgtggggtattactcagtacatttttgctgagactgatgtcctggagatttttccccaaagttttcttgtagtagttttatgatctgaggtcttagatttaagtatttaatccattttgattttatttttgtatatggtgagagataggggtctagtttcattcttctgcatatggatatccaattttcccagcaccatttattgaagagactatcttttccccagtgtatgttcttggcacctttgttgaaaatgagttcactgtaggtttgtgtatttgtttctgggttctgtattctgttccattggtctgtgtgtgtttttatgccagtgccatgctgttttggttactatagctctgtaatatgatttgaagtcaggtaatgtgattcttccagttttattctttttgcttaggatagccttggctattctgagcctcccatgattctatgtacactttaggattgttttatctatttctgtgaataatatctggtattttgatagagattgcattgaatctgtagattgctttgggtagtatggacattttaataatattgattcttccaattcatgaacatggaatctcttccaatttcttgctgtccacttcaatttctttaatcaatgtttgatagttttcattatagaggtcttccacttctttggttatttcctaggtatttaattttatttgtggctattgtagatgggattaatttcttgatttctttttcagattgtttattgttggcatatggaaatgctactgatttttgtatgttgattttgtgtcctgcaactttactgaatttgtttatgtgttctaataggttttttctgtggagtctttaggtttttccaaatacaagatcatattatctgaaaacaaggataatttgacctcttttaatccaatttggatgcactttatttctttctctggtccaattgctccggctagcacttccagtactgtgttgagtaacagtggagaaagtgggcattcttgttgtgttccagatcttagaggaaaggctttccatttttcctcatttactgtgatactaactgtgagtctgtcatatatggcttttataatttgaggtatgttccttctatacccagtttttgaggatttttatcatgaagggatgttgaattttatcaaatgctttttcagtgtcaattgaaatgatctaataatttctgtccttcattctgttgtgatgtattacattgattgatttacgtatattgaaccattcttacattcctgggataaatcccacttggtcatgatgactgatctttttaatgtattgttgaatttgttttgctagtattttgttgaggatttttgtattaataatcatcagagatattggcctatagttttctttttttgatttatctttctctggttttggtaacagagaaatatggtcctcgaagagtgagtttggaagtatttcctcctcctctattttttggaatagtttgagtaggactggtattagttcttgaaatgttcagtagaattcagcagtaaaaccatcgggtcctgggcttttctttactgggagactttttattatggcttcaatcttgttacttgttattgatctgtttgggttttagatttctccttggctcaatcttggaatgttatatgtgtttaggaatttgtccatttcttctaggttttcccatttattggcctacagttactcttactatccactaatgatcctttgggtttctgcagtatcagttgtaatgtctcctctttcatctctgattttatttatttttaatccctatttttttcttagctagtctggctaaaggtttgtcaattttgtttatcttttaaaaaaaatgacctttcatttttattgatcttttgtattgttttcttcatttcaaattaacttattcccgctctgatctttattatttattttcttctactaattttgggttcagtttgctcttgcttttctagttcttaacattagattatttatttgaagttttccttctttttttgatgtaggcttttatagctataaactgctctcttactactactttcattgtatcccataggttttggtatgttatgtttccattatcatttgtttcaagaatttttacaatttctttcttgattttttcattgacccgctggtaattcagagtatattgtttaatttccatgtgtttgcatagtttctaaaattcttcttattaatttctagttttattctgctgtggtcagagaagatggttgatgttatttcaatttttctgaatgctttaagacacccgatcttggaagaccatcattaaaagtcttacttttgctgttctctgggtctctgagtccattctttgggtttggacgggtgagtttgtttctcacatagagtcaaaaactttagaaatctacctggtgttctattgtactgtggctgagctggcactcaaaccacaacacacagtccttgccactcttccctcccctttccaaaggcagaggagcctcaccccatggccactgccaccacaggtccccagggagtactgccagactactgccaatgttcccttaaggcccaagggctcttgagtcagcctatcatgaatgctgcctggcctgggactcaccattcagggaaatagtctcccctctggcccatggcacgtccagaaatgccatctaagaaccaagttttggaattgggcaccccaagagcttgcttggtgctccaccccctgtggctgtgctggtacctaaggtgcaagacaaagtcccctttacttttacctgtgcttttctcaagtggaaggagtttcaccccatagccaccatagttgaaaatatatatgcacagtctcacctgaagccagcaaatctcagagggtcacccaaggccctcaacgtagttcctgggtattgctgctggttattcagggcccaaaggcccttcagttagcaggtgacaaatccttccatgactgggtccttcccttcaaggtagcaggttcccttctggcccaggataagtctagaaatgtcatctaggagctagagcctggaaaaagggcctggcaactctgaccagggccctaaggctagctggtatccaagaggcaaaacaaagtcctccccactcttccttctctcctcaagtggtaggaaaaggtctcttgtagagctgtgagctgtgcatgcagcctggggttagaggtgaggtggtggcagcactcccttaactgccctggcaagtgtttcagtaggtaggtcacatgccccctgtttaatgtctctgggcccagttcagcattaggactcacataaaagttgcagtccttgtggcctggcccatctttcaagtttttttaaggcgccaagggcattttagcccatgatagcaaggtttgctggaactcaagtttcaaccgctgtgattggtaatacgcctctgcctagagctggtttaaatgctccctccctgggcaggaatcagctgaatttggtctggttttcctttctgctctaacaggacagcactgagttcaatgcttcacaattgctgtgctatctttctgccaacaaccagagatgctctcagcaccacgctaccactgcagaggtggggggacatgacaattcaagactattttttctacttctgcagtgcttctttcagtgatatgaagttaaaaccaggtactgtgagtgctcatctgatttttagttcttatgaaggtgtttttcttgtgtagatagtttaaaattggtgtcctcgttggggacgattggtggaaccttctattccaccatcttgctttgtctctgcaccttgataacatatttttctaaacttcttaatagggaactaatcatagagcaatataaatatatatattttttcatgaaaaaagacaaggtgttggctaacctggattttttaaaatgatgaataatagtcacaattttgaaggcctttggatgtttgcctctgcccctaacactttgaacatattttccaaaaaaaaagcttcaaagaataaatcctcatttctcctcacctccctagtcaaatgtcactttccattttgcaatgttaaagacagctcaaggagaagacagttataagtaaataaatgtcttttcccatttctgtagcctttgatgatgccacagagcctttacattaatttgagttaccaatcctagatctcaacatctcattataacactgtaaaccagatttttagataaatgttgccctaaaggaatgccttttgtgaaaaagaaaataaaagaggaacttctgtaagaaatggaaacaatcaattttgattatgtgtctggtggaggggaacaatggttcaaaaaataaaaaatcattctatatggctttggaatttgtcactgtatgggcctttaatattcatgtatttaggctgggtgcggtgggtcatgcctgtaatcccagcattttgggaggccgaggtgggcggatcatgaggtcaagagatcgagaccatcctggccaacatggtgaaactccatctctactaaaaatacaaaaattagctgggcgtggtggcacacacctgtagtcccagctacttgggagactgaggcaggagaatcgcttgaacccaagaggcggaggctgcagtgagctgagatcatgccactgcactccagcctggcgacagagcgagactccgtcaaaataataataataataataacaataataaattttctgtgttgggatgttttggtatcttaaaatagcaaatgaggccctgcaagtggatttcctgactgaggagtagtccaggagttgtctgggtttcctaaactcatttattgttctttctacaattcccagccctatgctggggatggatggccttgctatccagatcgctgcacagtctgtcttggctgggctgcctatgtctagctttccttaagacagcttttgctcccatttagagtggcagggatagttgttttggattaaatatcaacttccaatgttctctgggctataaagagatggttaaagtgctgataaaggatgaaagtgaagagaacaggcaaccaagaataagaactgtgacagatatgtctgcaaatgattaagcattgacttgggggtaatgttttacagtttagtcacacaggtcatgtgcccaaggaactactcatatataaatgaagactaccatgtaaatgctaatctaattttgaaaacccagagagaaaaggacatttttgagctggaaaggatcttcatctggtccaagaaactaaagatcaaggagattacattaatgtcccagcccattacaatctcagtattcgggactaaaaattagtacccatcaatgtatttactggctctgagacttagttaaatcggctggaaaataatgctaaggaaaacatgctcctaggcagtttttaagccacaagctatatccctagtgtgaaagctcaccatcagtgcaagagactcatttataccaaggggctttggtattaaatgagaacgtggggctggatcactatagctccatctctggacaaactcctacatagtaaaagtgaaataggaagagtgatatctaaagagcttgcagtctaatgtttgttgataaatgttgctaagtaaaaacaatactactgtggagtcttaagtttgaggatataaatgaccagtagagctggttgagctgatgctctaactgacccttgtgcacctatatagcacaatgataatgcatatccataaaaaaagaactatgggaattgtaaaagattgcatttcttctgagttgataaatgaggactataattccagtcactctggtttgctgtcaagggtatttccctgttctctttcttcaagaaatggcagttcactctgactggctaataaaagctagcttgacacatttacactgagccacagggctgatggggtaagtgccaggaaagcagaggattgtattggatgaatcaagagcatccaattctactgagctgagcaggagcaaattgaccatatttgacaaatgcattcagtagacctacctgaggaagaaagtcacaggaggacagcaaggtctcactagccactcgcttcttttcaacactgccttatgcatttacttctaacagtttcacattcagtcatcctgtcttatccaataagtttgtccttcttcctcctttctgcagcagaggagtctaagtgactcctcccacttattgatgctcttctcagtgcttctatgctgtgtccagttctagctaaacactccatctgcattttctcagtaggctgagtttttatagaaataactcctaggtgttctgcagcaatgtctggatcaatattgattggtagtttcctacagtaaagaatcattttaattgggtgtttctcttcagttaaatcctaatctaactttttttttttttctgtagctcaggctgtattttaacagcatgctcccacaccttttctttctttctttctttctttttctttctttctttcttccttccttccatccttccttccttccttccttccttcctttctttctttcttttttgagatggagtctcgctctgtctcccaggctggagtgcagtggcgcaatctcggctcactgcaagctccacctcccgggttcacgccattctcctgcctcagcctcccgagtagctgggactacaggcacccgccaccacgcctggctaattttttgaatttttagtagagacggggtttcaccatgttagccaggatggtctcgatctcctgacctcatgatccacccaccgcggcctcccaaagtgctgggattacaggcgtgagccaccgcacccgaccctcacacaccttttcaacacttcgaccaatgtccatatcaccaaagagatcagtacatgaatcttttgagtgaattgcttctactggacaatttaaaactttactaataatcaaagaagacaccttataagggaagaagttgtttgtacgtttaatattataataaagttgttcctgtgttccaaattgttgtagtacatgattataagcagaatcaataacctgagaaataatttctgtactttctggacttgaaaaaccattcttcaggattagcagctataacactaatgttttctctggaaatttcagatgtcatggattttcttaattgagatgcgattttatttaactcaggctttgataagttttagcatctttgcttgaggcccttggcaacttaattagtctagccaagaacaaggccaatattttatcgaaaatcatggcattaaacacagcatcttttctgggtgaagtctttttctttgacttaaggacatcaataatcttaaccatgttttccagaattttgacagtttccataactaattctgaatttgatgcttcttcctccacttgagggtaaaattgagtttcctttaccattcaaaattgagaatttttttttttgagaccagagtcttgctctgtcacccaggctggagtgcagtggcactatcttggctcactgcaacctctaccacctgggttcaagtgattctcttgcctcggtctcctgggtagctgggactacaggcgtgtgccaccatgcacacctaatttttgtatctgtagtagagatggggtttcatcatattggccaggctggttttgaactcctggcctcaagcaatccacccaccttggcctcccaaagtgctgggattacaggtgtgagccaccgcacccagcaaggacattgttcttacgcattaaatctttctacactgaaatattacccagagtgctttaaaacactgttataagcagaataactactttttcaatagttgcactgtctgctaaagacagggtgagtgactctttgccctgtggtacgactttaatctgacttttagacatatatttttgaagtaaatgtacgatttttaaggttagtttttgcatttcagcatttagagacttgttttgttttttatcaattttggaaacatagataaaagcgttggtaaaaaaagtatagcaatatcttctattatgttaaaaggcagtttgtaagcacgtgatggctgactatgggggacccccgtggtttagacatgtttaagcatattttcaacaacactgtcaacttctgtacacttatatgaagttagctctccagaaaaataggtcagcagctgattgccagccacttcctgtacaactaaactgatttctgaaagtattctgcagccactggtgacaaaattttttatgctttcatgaaatccaaattgtcgctgattattttaaatagtctgaaccactaaatgaataatttcatcatcattaggatgtaaggattgtacatcctgtataatcaatcatatattcatctttggagaccactgtcataattgaatttacttcatttgaaggtaatccagttctgtatacaaattatcttcagatatttctgttgcagtgttggctactgtcgagaattttattattattattattattatactgtaagttttagggtacatgtgcacaaggtgcaggtttgttacatatgtatacatgtgccgtgttggtgtgctgcacccattaactcgtcatttagcattaggtatatctcctaatgctatccctcccccatccccccaccccacaacagtccccagagtgtgatgttccccttcctgtgtccatgtattctcattgttcaattcccacctatgagtgagaacatgcagtatttggttttttgtccttgtgatagtttgctgagaatgatggtttccagcttcatccatgtccctacaaaggacatgaactcaccatttttaatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcgtgatttataatcctttgggtatatacccagtaatgggatggctgggtcaaatggtatttctagttctagatccctgaggcatcgccacactgacttccacaatggttgaactagtttacagtcccaccaacagtgtaaaagtgttcctatttctccacatcctctccagcacctgttgtttcctgactttttaatgatcgccattctaactggcgtgagatggtatctcattgtggttttgatttgcatttctctgatggccagtgataatgagcactttttcatgtgttttttcattgtgtaactgtcttcttttgagaagtgtctgttcatatccttcacccactttttgatggggttgtttttttcttgtaaatttgtttgagttcattgtagattctggatattagccctttgtcagaggagtaagttgcaaaaattttctcccattctgtaggttgcctgttcactccgatggtggtttcttttgctgtgcagaagctctttagttaaattagatcccatttgtcaattttggcttttgttgccattgcttttggtgttttagacatgaagtccttgcccatgcctatgtcctgaatggtaatgcctaggttttcttctagggtttttatggttttaggtctaacatgtaagtgtttaatccatcatgaattaatttttgtataaggtgtaagggagggatccagtttcagctttctacatatggctagccagttttcccagcaccacttattaaatagggaatcctttccctattgcttgtttttctcaggtttgtcaaagatcagatagttgtagatatgcagcattatttctgagggctctattgtgttccattggtttatatgtctgttttggtaccagtaccatgctgttttggttactgcagccttgtaatatagtttggagtcaggtagtgtgatgctgccagctttgttcttttggcttaggattgacttggcaatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtgagttggattcttaggtattttattctctttgaagcaattgtgaatgggaattcactcatgatttggctctctgtttgtctgttattggtgtataagaatgcttgtgatttttgcacattgattttgtatcctgaaactttgctgaagttgctcatcagcttaaggagattttgggctgagacgatgggtttttctagatatacaatcatgtcatctgcaaacagggacaatttgacttcctcttttcctaattgaatgccctttatttccttctcctgcgtaattgccctggccagaacttccaacactatgttgaataggagtggtgagagagggcatccctgtctgtgccagttttcaaagggaatgcttccagtttttgtccattcggaataatgttggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggtcctgtttatatgctggattacatttattgattttcgtatgttgaaccagccttgcatcccagggatgaagcccacttgatcatggtgggtaagctttttgatgtgttgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagctcctccttgtacctctggtagaatttggctgtgaatccatctggtcttggactttttttggttggtaagctattaattattgcctcaatttcagatcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggataggtggtgatatcgcctttgtcgttttttattacatctatttgattcttctctcgtttcttctttattagtcttgttagtggtctatcaattttgctgatcttttcaaaaaaccagctcctggattcattgattttttgaagggttttttgtgtctctatttccttcagttctgctctgatcttagttatttcttgccttctgctagcttttgaatgtgtttgctcttgcttttctagttcttttaattgtgatgttagggtgtcaattttaggtctttcctgctttctcttgtgggcatttagtgctataaatttccctctacacactgctttgaatgtgtcccagagattctggtatgttgtgtctttgttctcattgatttcaaagaacatcttcatttctgccttcatttcgttatgaacccagtagtcattcaggagcaggttgttcagtttccatgtagttgagcagttttgagtgagtttcttaatcctgagttctagtttgattgcactgtggtctgagagacactttgttataatttctattcttttacatttgctgaggagtgttttacttccaactatgtggtcagttttggaataggtgtggtgtggtgctgaaaagaatgtatattctgttgatttggggtggagagttctgtagatgtctgttaggtctgcttggtgcagagctgagttcaattcctggatatccttgttaactttctgtctcattgatctgtctaatgttgacagtgaggtgttaaagtctcccattattaatgtgtgggagtctaagtctctttgtaggttactaaggacttgctttatgaatctgggtgctcctgtattgggtgcatatatatttaggatagttagttcttcttgttgaattgatccctttaccattatgtaatggccttctttgtctcttttgatctttgttggtttaaagtctgttttatccgagactaggattgcaacccctgcctttttttgttttccatttgcttggtagatcttcttccatccctttattttgagcctatgtgtgtctctgcatgtgagatgggtttcctgaatacagcacactgatgggtcttgactctttatccaatttgccagtctgtgccttttaattggagcatttagcccatttacatttaaggttagtattgttatgtgtgaatttgatcctgtcattatgatgttagctggttattttgctcgttagttgatgcagtttcttcctagccttgatggtctttacaatttggcatgtttttgcagtggctggtaccggttgttcctttccatgtttagtgcttccttcaggagctcttttagggcaggcctggtggtgacaaaatctctcagcatttgcttctctgtaaagtattttatttctccttcacttatgaagcttagttttgctggatatgaaattctgggttgaaaattcttttctttaagaatgttgaatattggcccccactctcttctgacttgtagagtttctgccaagagatccgctgttagtctgatgagcttccctttgtgggtaacccgacctttctctctggctgcccttaacattttttccttcatttcaactttggtgaatctgacaattatgtgtcttggagttgctcttctcgaggagtatgtttgtggtgttctctgtatttcctgaatctgaatgttggcctgccttggtagattggggaagttctcctggataatatcctgcagagtgttttccaacttggttccattctccccgtcactttcaggtacaccaatcagacgtagatttggtcttttcacatagtcccatatttcttggagggtttgttcatttctttttattcttttttctctaaacttctcttcacgcttcatttcattcgtttcgtcttccatcgctgataccctttcttccagttgatcacatcggttactgaggcttgtgcattcgtcatgtagttcttgtgccttggttttcagctccatcaggtcctttaaggacttctctgcattggttattctagttatccattcatctaattttttttcaaagtttttaacttctttgccattggtttgatcttcctcctttagctcggagtagtttgatcttctgaagacttcctctctcagctcgtcaaagtcattctccatccagctttgttccgttgctggtgagaagctgtgttcctttggaggaggagaggcgctctgatttttagagtttctggtttttctgctgtttttcccccatctttgtggttttatttacctttggtctttgatgatggtgacgtacagatggggttttggtgtgggtgtcctttctgtttgttagttttctttctaacagtcaggaccctcagctgcaggtctgttggagtttactggaggtccactcgagaccctgtttgcctgggtatcagcagcagtggctgcagaacagcggatattggtgaactgcaaattctgctgcctgattgttcctctggaagttttgtctcagaggagtacctggtcgtgtgaggtgtcagtctgcccctactggggggtgcctcccagttaggctactcgggagtcagggacccacttgaggaggcagtctgcccattctcagatctcaagctgcgtgctgggagaaccactactctcttcaaagctgtcagacagggacatttaagactgcagaggttattgctgtcttttgtttgtctgtgccctgcccccagaggtggagcctacagaggcaggcaggcctccttgagctgtggtgggctccacccagttcgagcttccctaccactttgtttgcctactcaagcctgagcaatggtgggcacccctcccccagcctcgctgccaccttgcagcttgatctcagactgctgtgctaccaatgagcgaggctccgtggacgtaggaccctctgagccatgtgcgggatataatctcctggtgtgccatttgttaagcccgttggaagagcacagtattagggtgggagtgacctgattttccaggtgccgtctgtcacccctttctttgagtaggaaagggaattccctgaccccttgtgtttcccgggtgaggcgatgcctcgccctgctttggctcacgcacggtgcactgcacccactgtcctgcacccactttccggcactccccagtgagatgaacctggtacctcagttggaaatgcagaaatcacccgtcttctgtgtcgctcatgctgggagctgtagactggagctgttcctattcggccatcttggctccacccaccgagaaaatttttgatagaagagaagaaattatactctaaaaattcacaaggcagcattgtagtatatggccatgatgcctgacattttttgcaggctgtttggggcaccttttcgaccttttaaatgaactcccaagattctagaggcaaacatactgaagctggaacctcaccacaaagtaacaaggttagctgatgctgaaaaacttctcctattactgcattaactagccttgtgctaaattttcactgttactgttatgtccttacaaatggagtcttgccatctatattcctgcaaaatattgcatacagatgagcaaaaaatcatattgatcaacattttatcaattgattgtgtgttagccattaaaagtacctcatctgaaggaggtgttttagttgcaggtggcattctatgcatggatggtattttgtctataattatcattttttatcttggatggtgctttatccacagatagttctttctgcctgagaggtactttatgaactgatgtaactttatctgcaggtgggaagggctgatttccctgatctgggtttaacactttaatttgagcatctgaaaactcctttaacacggaatcaatcggtttcatagctgcctcatagatctcatcttgatttatgtcactggttacatttcaacatgcatcatctgtgtctggtgaggaagaaaaatcaatttgttaattatttcagagataacttcttctaagaaattggctgacaaaatcccagggttattttctggtgggttttgagaactgtctggtttactaggtttacttttaatctctttatctttacttttctcattctcttcctcagttgcaggaacattttggttagctcaatttgttgaagcaggctgcgcagaatccttaccatccacctgagttacatctgctgcattatcttctagggtctttgggattttgaatcacctatttgtccttaaaaagaagatatttctaaatattgctgtaaatgctttcagtgacattttggacatgttcagaatgtgagatttgtttatcatctgtaactctttaagctggagaatctctcttcttctcttggatctatttttcaccttgattttcagagatggtagtttaagaggtatgttccctttttctaatgaactttctcttttttatcactcttcctttttatcatctattttaatatctagttccagtccaacgttcttgtgttttgtgtcattggtactcggtgaaaaatgctggtataccttctcatctagacctttttctagctgaattgtctttcttcttgatttcatcctttgtaagtgctatattcaaatctggaaaagttgttgaaataacttttgatacatttccactatcttctctaattgaacttccccctttcttttcctcctctttctttttatccaccacacctccagctaaccctaatgctagggtactttgccgttcataatgctagttatatcggtacatattggctcatgaatggtgccttttttcattgatgtctccttctttttgaaaccttccttttaattaaatactcatctacctatttccaaagtgtcctttttgtttttcaggcctgatgtagatgactgaacaaattggattcctgatatggtttggatatgtgtccctgcccaaatttcatatcgaattgtaatccccagtgttggagatggggcccggtgggaggtgattggatcataggggcggagttctcatgattggtttagcaccatccctttggtgctcttctcgtgatagagttcttgtgagatctggttgtttaaaagtgtgtagcacccccctccccctgccccctttgctcctgctcctgccatataagatgcctgctcctgctttgccttccgcctgaaggaatgaataaaagctccctgaggcctccccagaagcatatgctggcacaatgctgcctgcacggcctgcagaaccatgggccaattaaatctcttttctttataaattacccagtctcacatacttctttataacagtgtgagaatgaactaatacagttcccctttaaacttccatttatctttttaaaggttttaaatggcaggtgttgaattctttggataatgttatccacatctagaaatgaaaagaaggtggaagaccagtctcctgaaaaaagcagttgaattttgaaagcagagatcacctttttggctaaagtagcaataaactctataacaatgttacttctgtcatttcccccaatattgttagatccatatatttctacgacttcatcatacacggaatcagatactttatcaactgtctgtttatccattggtggaaaagaaaacatttcttcagcatttattagaattttaatttcacttttcctaaattatcccaatcgggtcatttgtaaaatttatagcatttccatgaggttttattccaatatttctttgtccttaggattttcagcaatactttggagagtataaaacttgcaaacaaggtcaattataacgtcgtccagaaatgtagcagaatacacagaagactgtggtagggacagtgctttttcattagcaggattcaagaattcaatgacatggtcattttcaggtgagtcactggaagatgcttcttcatcacataaaaatgtctgcacatggtgatctataatttccttcataataaaaccagctattctcccaaggaacgagccttcctttttgcatgtattgttctgtgcttcagcttggaatttaatttttttcataatattgttaagtatggaatcaacgaagttctcaattgcccccagttgcatgctttctgtgtgctcctctgcagggacaaatctaatctcacgttcagaaatttctaatttcaccagtcagttctgaaactgcatcaacaaactcataatttggcagcacctctccctcttttagtccagtttcagtctcagataaagggaatatacatgctggaagcacataaatcatgtcttctaaaagagaatgaagcaaaacagagatgcatgaaggcaagagatggctatcatcattgatgatgttgagtacatttctgatgatagtctcatcttggagagtggagtaagaagacattaataattttcctgaaactaatgactctacctgataatcataaatttcttcttatagcaaacaatatatttttcatccaaaaccaatgacatcattttgtatagccctatatatatgaatctgagacataatcatttaatatttttcaaaaattaggttgatgacttttttggactatttctttatattcttctgaaaaatacagatttttgtcctacttatctgcaagtaaaattcgtgatgtggtgaactccagcatagttgattttactaatgttgtaacaatatcagtaatgttggcttttgctttatgtggattttggccacataaagatattatgtgagaatacataaaagattttgcataaaagcccagaaattacttcctccaaaaagatagctgaattcacgatgaaggacaattctctttgtttaggatctcttgctctttgattatgagtttgatcaacagtatgaagaaaaagttttatctccagataaaaatgactgaatatgatggttaaatatttcttttattatataacttgctatttttgtaataggtatattacttatgccagataaaaatgactgaatatgatggttaaatatttcttttattatataacttgttatttttgtaacaggtatattatgtgtttttaccttttgtaagagactcgtatagatttgaatgagaaatatcactataaatggcatcaaccatagcctgaacatcattttctgaaatcacattttgtttttcatttccatatttaataatgcatattgcatgtttagaaattattgacatgatttcatcaatcaatctcatgacttactgaagtctcatcatgaaagttctgggtcttctgtactgaagtccaataaacttatctgagataaaacttgagtgactattttttctgaacgtgtcatgataatacggtggtatatattgtacacgtctatcttcagagtatttatttactaatatcataatgaattctctttaccaaatcatcagcattgagttttgaatatgatttttttttaagacagggtcttctgtcgccctggctggagtgcaatggtgccttctcgactcaccacagcctctgcctcctggactcaagcaatcctcccacctcagcctcccagactagctgggaccacagatgtgcaccgccatgtctggctaatttttgtatttgtagtagagacaggtttttcgccatgttgccgaggctgatctcgaactcctggcctcaagcaatccacccgccttggcctcccaaagtgctaggatcgcaggcgtgagccacggcacccagccttgaatattatttaaaaggcagctttggtatgacatctggatgaatttggaaatcagaaacttcagccaggataattttagctaccctctcagccaatgtctttgtgtcattgagaaaatctttatcaggtagttgttcctgttcatatccttgtaaaactttgttatttaccacatcagaaattttgacaattacatatctactgggggaaaacacaattgtcccttagtattttctaggatgctaacttggacttttgaaaattcttctgttgtcaaatatattattacttcagctgtctccaaaagttcttttttctgaatctcttactgattttgtttgtgcaatgcttaacactctatggaatattttgcttaaaactccagagatcatgtcttccaagaagtctgagaagtaaacaccagtagaaaaactgtggccttcttgcatcatcaaaatatgtatattatgaaggaagtaacaaatttccatatacaaatggataaagatgttgacagatatttctaatgataaaatctgccattctgtcaatagaaacattgttactgcttgtgatagcacgttcagctgcttcctgagacccagagttttgcaaaatatttctaaatactgaattaacgagatgctgagcatcatcctctgaataaacagagttggtttttcttcatcttttgaaactctaattccatgttggaaacttttcatcttaatatcactaattagttttggagagatttcattgaaatttattcctgatctggagtttcactgcatggaagcaagctagatgcagaagaaaatattctggataacagtactttgattgtgtcttctaaaaatgtgtatggcaataaggtgttatacagagataaatgctgccttgacttcgtagatttactaatggcactaaagatattcttaataatattttctgttgttaaagtggcataggaagctgacaaatccccagaaaacagttgatgaaaaagataaacacaaatagctgccacaattaaattggtaatatcttctgcaaaaaatatcactgtctttttggtaatatcttctgcaaaaatatcactgtatttttggtaacatcttctgcaaaaatatcactgtctttgagttctttactatcaacctcaagggccagcccatgctgtttcagaacattcttataagctgtattgacaagttcacccacagtgtctgtatctacagtgggaaaggattgctcttggtaatcacaagggatgcaaattttagctttgttgaaattgttatttattgaatttactatttttggatcattttatccagttcatgctcagtgttatagctcaggttgaagacctttgataaaagccttacaacaatttttcctacaaatgtatgagggtaaaaacctatagccagtggtgatggggttttctggggtctgtgtgactctgtgacttcactgagaacctccttaaccatattggatatttcatccaatggagtctttggacaaggtaagccctcgccacacaaaaaggattgaatgattttcaataatcttgactaataagactggctgtccagtcaatcataatttggctttggcctgctgtaacttttctgtattgacacaagagagtcagacatctgaaaaatattatcataaacagattccactatattttggaggtctttttctatacatagatactaacgaccatatttagtgagccaaatcttatgctttgaaaatggctaacataactttacttattatacaggtggatttctcattaaaatctgaagtcattaaatagttccttcccaagcatgaagtcttgctgtatagagaaagagtggagataatagcctcctgatgacatcttctaaaaatgagtgtgataacatggtaatgtagcatgttgaatgttgaacttggtaaataagttatttcaggttattctgaagtttctgcagtatattttcagctttgagagagtaatatgaattaggcatgagcctttcttcaaaacacaatgggagttgctagtctcaaatctctatcagtatgccattagttatctgctctgctactggggtgatagtgtgtgccagatgattaccacaagtcacttgcaatttatattcccgtaaagcatcgttataaactgagtcaacaatcttacgagcacttttttttttttgagaacaagtcttactctgtcaccctggctagagtgcagtgagtggcacgatctcagctcactgcaacctccacctcccaagttcaaacgattctcctgcctcagcctcccgagtagctgggactataggcacacaccaccatgctcagccaatttttgtatttttagtagagatggggtttcaccatgttggccaggctgtagactagttggaaacatatcctttcttcaacaccctataaaacagtgacttgagcattattaaactcatttaccatggggtaaacacctaatatactcacctcattgaactgggcctcagtgatatttatatttttttttgcccaaaatgaggtatagagattaagaaaaatgcctacaattatttcctccaaaaatgtggcagagtaaactcctgggttcatgccttctagatgttgcatgctatgaatggctgctatatttattgcttttctcctggtcttcaaagaggaggtagacaagagggttttcttggaagttgcttaccaaataggcttctatttggaacagatagctcagatactatccagtgcccccttcaaaggcttgctgtcataactcatgaaacttatagagccttttccttatcttgattattttaattctggcctttttgcttttaggaaattagaaagtctccttcttttcctatatgcaaagaatgcaaaggatggacatcttagaggttgctgtacgtggtgtgattgtttttccattaaggattttacaaaactatgggaataaaactaatcatatattcttgatcgattccctccagattttccaaaagttcttgtattaggtcatttttgcattgctgtaaagaaatacctgaggctgagtaatttacaaataaaagagctttagttggctcatggttcggcagacagtacaagaatggtgtcagcatctgcttctggggagggcctcagaatgcttacaatcatgatggaaggcaaagggggaaaaggcacttacacggggagagcatgaacaagagagaaggggaggtgccatacacttttaacagatcttgtgagaactccttcactaacctgaggacaattctaagctattcatgagtgatcctcccccatgatctaaacacctcccaccaggccccacctccaaaattggttcattgttttcctgtaataaccaaatccttcttcctctgtattttgaagtacgttgaacagttgacattctgctgacatttcatcagaaagagggttatttgtaagagagttgtttgttgcgcattctcataaaagcattctaataagtttcttgcacacaaatttcagatgaaaaactgatttgggggaaagccctagattatttctaggtatgcaatgacttttctgattacttggagatgggaatattttcattgctattttaccagaatccatatcccaatttggccattcatctggcaaaaccaaatctaaaacaatatttacatttttattgactactttagattcacagtttttaggctaccaaccagagtgcctaaattacatgctagagaatttagtttatttttctgcatgagtttatcaatttgggcagtaggagctgatttccagtctctggagcctgcttgtcttttcatagttttgcttttgttgcaattggccaaattagggcttctaggcaaagaaaatgatttgtttcttccattgccataaggctgatgatttattcctatttctttgtacagaacatggatgactcctattaagagttcccgaaagagatcatcaaagtcacagtcacagccactcttgggcagtaaatatattttgtttttacagaaaccatttgttgggtaatgtctgcttttaaaatgtcactattaaacaggattcaaataatgatttcagaaatgcttaaagcaagttctctgatagaaattgactgactctccaacactttgtaataaactaaaataaccttgttaaaagctgaatcttgactttccagtgctttttgttttgacccactgtcttcggtgcaatcagacattctggaaattatataggaaataaacaattcagtgagatgttcatagaatcagataagggaaaaattgatgtttatgctttgtagaggctgttttgattcatattttttccttaacagtgtggaaacaatagatactttttcattatgaggaccttaaaacagaaaacattgctattttttaacatgcattcaggaaaaatgttgatcattcaaaatactgacaacattttgtatatgaatttcaccttgggtgcacctcactcaagaaataggaaaacctagttgagaaaggaactgggttttcttcatgtctctatttcctatctatggaatcccacttcagcaaggaagttaagaaggtagcccagcagaactcaaatctctaagtgccggtttcttccctgaatagctatgttgctttaagaagctggaaatcctagggcagagaaataatttctagttttagtgttgcagtgccctagtacgattctagtgatctctaaaggcctcatataattcttgaaaaaattttcacctattcagataattatactatttagtatatattaaattgaactgaatgaaattgctgatgttcaacagtttttgacatacaaaatggctatttcttatggttcactccaatacatgtatgtaagcattcatagaaagggagtgcaaatagagtctttgtaagcatggacttaaagtataaccacatcaaaccaatctggttcaacttttatgtataaaaatgtgagttgtttttcagttatcatggacccccccacccccggttgaaggtcacataacctgagcgtgcccagatgaaccacctgtgcaaccacagggggaactgaagtacttggacagaagagtggggacagaattagaagtgaacaccacatggcaggatccaggatccaaccagattgagctatggcatcaccccatggcaggatccagtcagatcacacctcccagctccaacacattgcaagatccgatcatatcagcttcaacacattgcaagatccgatcatatcgcacctcattaccctatgcttataacccctccatccccaccctcagcccccagcttggggagacagatttgcgcatttcttactacctccttgccagtcgactcagaataaagctgctttttatttttttcttaaaagccagggccaatgtattgacctctatgtatattgggcaacaagcccatttattactaggtaacaaaagtattatagctaaaaagaatttgtcagacaccagaacatgagcagaacaagaaatttaatgccactgttcttataaactgtcaataataaagctaacaacttaactatatacttcaaaaagaaattgaatcattactttgccatcaattacctatacatgaggtctgactatgatgtaagaagtcttgtaaagaacctaaaaaaccctcttgtaacttcttttttgaaattgcctttagagcagttgtatgtaccacacaaggaaactgatctcatcatttcatattcacacctcatacccaacctaaatcttctgctttaaactatgcctatttagggcatgttggctcacgcctgtaatcctagcactttggaaggccgaggcaggtggatcacctgaggtcaggagtttgagaccagcctgaccaatatggtgaaaacctggctctactaaaaatacaaaaattagctaggaatggtggcgggtgcctgtaatcccagctacttgggaggctgaggcaggagaattgcttgaacctgggaggcagaggttgcagtgagccgagatgacaccactgcactccagcctgggcgacagagcaagactctgtctcaaatgtatatatatacctatttaatcttatctgtggaaaaggaaaactgaacaacatctctccaaataaaaattatgtaaatgcaacacattttattctttaggatgctgaccagttgaaacacacaaaactattatagataaacagccactccaaatacaaggctgttttcagagaagcagaaaatacagcttcttgaggggagggtaaaaacaaaattcttaaaattatcattgatttttcttctaaagttttgccaactttttataaatcatctttcacttacctctggtttcaaagttcttgaaatttgtgaccgtagatgtagtaacatatcttgctactagatggattttatttggttccagttcctgttccataaaagcaacgacttgaacctcttcaaaagttgcaatttttttttctaacctcgggtacctgtttttccactttttcaataaagtgaaatctccacttgcttcaagtttgggttttctttttttctggctttataggtgattatttttccaaatattttaagcatgttttttgttcttcagacatcacagacaaaaccttttcctttgataccaaaaaagtcttccttgtctccatactttcattaatgggtgtggctgaacctggaagaccataactcagcaacatagtattgatgatattttctgcagctaaacatattttgagtggacgaatgtttgtctgtatttggtttgagtgaagcactctttgattttcacctccttccatttctctgaaggacatggtgtgctctaatgctgattgtgcagagacaccggatatctgagatagtttttgcaaaagactgactttagggagatggctgtttcttcttatagctggatcaaaatgcatgatgtcttagacatcacttctacaatatgatggtttaagctctaattcaagcctttccattgcaccagtggttttagttgtatctcttgcagaatatctgacatatgaaggtagatttgaggaagccctgtcttttcttttcatatcttcctctgaataaaacaccaagccagtgatttgtagaggatcatccttgctgataactccttttaactttgaagtgggcatttctattttgtttgtgaattcagcccaattaacagtgtaagcgttttcatttccttgaggcagattttcctttggatagtttttgatcaatgactcatagaaacgagtacactgctctataaaagttctgatgatctgatttgttacagtgtttttttcaaatgcactaattgaagatggttacacttggcattttcctttgtctatcttgttcttaattataccaatcatgtaatagcagtattagtaagcaattctgaatggaatgaatgaaactattgaagggcatcctgtatgttttcctgggaaattacggtatttgatttagattcatcaggaaacttatgcagtggttgtaatttggggaatattttttcattgatgatttttgttggacagcaaaaagttttcaataggcattttcacaatttcagagaaagcatctgtagtaacatgcttaaattgtacgtctgcaaatgactctaaggtgtttagaactccctggaagatcttttcagtgatttggtggctggagtgcaaaaaaaaatgtcttttaatgttgttttatagattgatacattggtgatgttgtttgttcttaccagagcttgtcttttgcttgagtttcttcactatctgttatgaacagcaaagtcaagaagcataactctaatttttcaaacaacatttcaacaatttcttggccaactatgccaatctgtgtttagaaatcctcagctctagtagaagctcttttaaaattatggtgggtcgggcatggtggctcatgcctgtaatcctaacactctgggaggccaaggtggaaagatcacttgagcccaggagtttcagaccagcctggacaacacagtgagactctatctctaaaacaaatttttaaaaataaaataaaataagataaaataaaataaaataaaataaaataaaataaaataaaattatggtatctgtttttacaagcctcaagaggtaacaaagttaaaagtgaaagactgctctaatttttttgcttttaataaaatttcattcaaaacagtctcagctaccatcaatagcttacatttttcacttcccttgtcacttgattctgtttaccatttatcaaatatttgttgaaaagtatcttctttaggaaaaattttctccagctgcaaagagacatcctccaaagaaaaacgtgcttctggatttgcaagataggttgcacttaatttcttctgtgaaagtttgaggttatctggatgtgagccatttattgtgtgagtcaaattgttcttgcttacatttaatccttgcaaaactatatcaacttcactttgctgtcacaagttgatcagaaggtaaagcttttacatttactattgttctactttgtgtcaccattcgaaattcattcacagttgtttccagaatattacgtactccatcattggcatacatttttagttccacagggggaagttttgttttcactaaggggtttttggcatcctctgttgacagcaggtattgcagcccaatggctgtctaggaccagctgccttttggagtcttctcttcaggacctaccttggttttgcttttggccttaacactactaggccctagctgtgtttttctccccccaaattagagcaaataaatagcttttgattttgtttcaatttttaaaatctaaaacctggtctagggctacccttaggaccagctttagaatgcatggcctcagagatcacatttcatcagactgacctttagggaatgaactcacttctagattcagcaaagcaaaatttgtgatcttttggagaacactttgaaccaattcccccacttgtaatggagaaaattgcaataatgtggtttccaatgaagtgatacttctaatgcctgtgaaagaataagttggcagcatcatatgttcagggggaagactttttttcctgcttatttaaatcccctaaagcatgacaaattcattggtaattcatcactgccagatgcttctaattctctcctggtctcattattttcatataaggatgtcacaactatcgagtacatttttccaaaattacttttgattgtgtcacttgcgacactgcttatatacaactgcaagaagtgtgggtgtgtgtgtgtgtgctgtagttttaatgttagaatcagatgttttaattttagaatcagatgtcaagtgggagggttcattaaaaggaagccaatagtctatgtgttccattaccctttgatacaccttctttaaaatttccttaactgcacttaagaaagcaggtggttattttttttttcctgtctagattatccatttctaagtatttcctctaaaacccttctcaggttttctcttctgatataatttggttttgatatgggtattttgataagaaagttcagtattgtcttctttctttgacccagtaatatttcattttgtacaaccagttgtgtgaagagactagggttctgttttgagtaaaaagtactttcctttaaagatattttatcattcagactcttcaagatattgtttacagtttcacttgcaatgatgttttcttggaatgaagtgttgtttgatataaatacatcttttggatttctagtttctacgtcattttaataagcatcaagacagtccttgcaatgacgtcagcatattccttaagactagcttgtaatatatgagttgtgggcccatgtttttctctgtaattatggattaaatgtgtaatccggggcctcttgacagaatgtttttacctgtagatattttcaggctattcaaatctgatgacatttggtttgattcaagaaatacgctgtcatcttgtttacaatttgtttacaatttctgggctaacaaataatttttccctagtcttaaaatcaagagtaagtagcaaatctattctttctgtggcaaaagattttaacctattcaaaacagctttagtaataaagttagttagcactttctgcacatgggtcaggagcagattgtctggtgtcttgtttcttaagcatagttgtctgattatcatcagagtaagctgatttcagctgtatatctgttccttttctcagaaatagaaagctctcccttttcttatcatttattgagttcataacaggaggttgttgacactctgctttgggaaatgcatcagacaacatcacggacgatcttgcagaaatagaatcatttgcatttatgccaagcatgacagcagaactaagattttgaggaatgatgtttaccatatgattggaaatcatagcaacgcatgacttaggaactaaaagtgttgaaatagacacatttgcatactcaggaatcattccagaatttgttcctaagcatgttatatttaagactaaatgcagcaagtgggaaattattcttgtccagtgttttctcacaaatgtcacttcagatacccacaatggtatctagtatttggaactggggttttgttttttcctttcttaagacagggtcttgctctgtcacccaggctggagtgcagtggcatgatcacagctatctgcagccttgaactcctgggctcaagttgaactcctgcttcaacttcctcagtaactaggactacaggcttacatcatcatgcctgtctaatttaaaaaactttttgtagagatggggtcttgctatgttgctcaggccagtcttgaactcctgacctcaagcaatcctcctgcctcagcctcccaaattgttgggattataggcataagccactgttcctggcctgatgtttttttcgataatcactttgaaaagcgtttccacaacatcttttagccaacctagatcaatttctctgtcagatatgtttttttcatacttgcctttagcaaatacaacatctaacactgtaaatctgacttgtaatactttctgacaccacaacattatgggttaagaatttacaatttttcattctatacaatgcaaatataaaaaagttgttcatatataaaaattaatttttgtatactgaccttgtattctgcaaccttgttaaactcatgtattaattccaatagctttttgtagatttcttaatattttcttcacacataatcacattattgcaaataaaaacatgcttttttctttctttccaaaaaaaagaaggaactttttatttctttatctaacttaagtttgattcattgtaaaatctgtctagccacttgtgtcacatatatatttaatttagagacagtcaattgacatattgaggcggactttcctgacttattatgatccactgaacaacagaaaaattgatcgccagaatacgaatctttggttgataaccatgattgacttaaagcagttgtatactgttgtaaaggtaaagtcattggaactgtgacattgatatgaggaaaaaggagacattttactttggaagcagtaaacatttcaaaatgtgctaatattgactgtataatatcttcaactagatttcctttggttagtttatcactattgaatctggcctgaagcatacgtggatttctgtccagcagggtggaataaacagaggcttttcctccactggtgtattcaggaaaagagatatttgctggaatggtgatagtgttacacttattttcatttgcattatgtctgtcacagcagtggaatacggtttttgaaatatggttctaacaacattatttgcaacaatgattacatctgcttcaagcactaaagaatccattgttttattccagggattgaacagatgtctgagcaactggctcacttccagcatgcggaatgtcatataaatgggactggaggagaggaagaacatttaactgatcaataaaatcattcttaagatttccattcaaaatatttcttataatggacacaattggggactttttggctctttgagttctactttaatttttttcagtgttcttttcaattcctcttgctcaagagactctgatttagtttcttcttttggaggtcttttctctccagcactttctttctctgtatctgcagaatcttctagatatgactctggtccagctcctccaggaagaaaatttctgtaggctggcctttatctgtaattttcaatgtctctgttttctgcttcagtttcattaaacgtatgtggaggcattccatcccaaattaaaatgactagcttcttaagcatttgtttctcttgtagtgggtcgtgtacacatttccaaatctggcaagctcacatttaatttggtttgaatagccttcaaaattgcacttgataccttctttgtatgaatgtgtaaagtggactgcaatagttcttgatgtgcgttagctcaaatgttggaactttcactttccccgtctgtcttgttgctctttttatttccattgattatagtacccacagttataaaatttcttttggcaagcccttccaatttagcaaaaaccatttcaatgatatatgaagtcacaacttttcatttatttggatacttttattttgtgctccctctttccctgtttcaggggcagtagttttccccttattggtagttgtctcttgactgccttgctggatccccctggacaccatgctggagattatatcagagcatctgctcatttcctcaataagtgaagcaaatgataagctgtcagggtcaatatactccaagatagctttaaattctgaacttgtgaaactgctatccacctcagcactacacaatcgtgtaatgatatattctagaattgtatgagaaatgagctgaatatcaggctgcaatgcagtgattgttcttaaattctcatcgatccactctctggttcactatcagatggggagaatgtgaatgatcttctacgagctccgattacatgtcatataaagtatctccagttctatctaatacttgtaatttggcacatttgtgaacttccttttgcctaggagggcactgaaaatgagaaaatgtttgttgatcaatgtcaacaattccatatgaaaatataggcctcagcttctgtgaagggagtggaacattgcttttatctgtctttccacttaacacttcacaaatacaatttactaatgaactttcaataatgtcattgtttagctttgtgacaacagcctaattcctttccggttttatcaaaaactactgtatctatatacttcttgggaggacccttctccctaagatttagattcttctcattgtatttcagttccttcttgatagcatccagacaatttttcccactttagttgtgtatacactaagttgagatttaaacaaagattccttgccaggtgcaggcttcaaactagcagcatggctttctggtttgaagcatttttgcaattttgaacaaatacgtgactttggcatcttaaaaattttatgagtgttttctttttcttataaatttgtttaagacccttgtagactctggatattagacctttgccagatgcatagtttgcaaaaaatttatcccattctacaggttgtctgtttactcggttgatagtttcttttgctgtgcaagaagctctttagtttaattagattccatttgtccatttttgcttttgttgcaaaaaaaactgacttgtaatactttccgacaccacaaccctataaaaaagtggacaaaggatatgaacacttttcaaaagaagacatacatgtggccaataatcatatgaagaaagctcagtatcactgatcattagagaaatgcaaatcaaacccacgaggagatactatctcacatcagtcagaatggctattatgaagtcaaaaaataacagatgctggtgaggttgtggagaaaaaggaatgcttatacactgttggtgggagtgtcgactagttcaaccattatggaagatagtgtggcgattcctcaaagacctaaagacagaaataccacttgaccaagcaatcccattactaggtatacacccgaaggaatatacattttatttctgtcattttattatattttattttatgtcattttattataaagacatatgcacacatatgttcactgaagcactgttcacaagagcaaagacacggaatcaacctaaatgcccatcagtgatagactggttaaagaaaatgtagtacatatacaccatggaatattatgcagccataaaaaggaatactatcatgtcctttgcaaggacatggttggagctggaggccattatccttagcaaactaacacaggaacagaaaaccaaataccacatattctcactgataagtgggagctaaatgatgagaacacatgggcacaaagaggggaacagacacgggcctgcatgagggtggagggaggagggagaggatcaggaaaaataactaatgaatactaggcttaatacttggatgatgaaataatctgtacaacaaacccccatgacacaagtttacatatgtaacaagcctgcacatgtacccctgaacttaatataaaagttaaaaaataaaaatggaattacattttcaaaaattctatgagtaattttatcattaatatgaactaaaggctcactttcttcagactaaccagggatgttttttagggtctatactaagcacagctaaaaatttcatcttgtttttactctctaatcatatttctaatagctctttatttggtacaccagtattatctagagaagtttggtgtactaatggagaaaatgaaatgtttggtggtgttaatgatgtgactagaagccatgtgtaatatttttaatacaccatctgctattcctgagctactgcatggatttctgatgcagagaacatctggttcatacattcttaatgtgacagacctcatggtttttctaaggtaagaagtaaagcttcttgaccatttttattgactgaatggccatgggacacagaagatatgtctttgagcacttctgctaaaatagttgtaattatgtttttggatgcattttgtatttgatgttttgcatcatggctaaaaacccaaatgtctttgttcaaataggacttgtccatgaaaaggtttttagttattaaaagctgggaggtcagtctttaacccccaatcacaaaatgctactttgtcttgacaagcaggctttgtagttgagttggcgtttcttttgcatttaagaccagtatttccccttgttgaccagtgatcaggaacctgttcttgtaattttgctttttcatccttgataggtgaaatcagtagattttccacaactttgtttattcttcattattgtctttggaataaaagaccatgccagggacattaacaagttgatggtcccctagatacgttgctcgtattcaggggaccatgaactactctagtgccagagagtctgttctctttttcagtgccaaaaagactgctcgttctggagcatctactctcttggacattgttttcattggtttctgatgtaagtgagtcaagatattgacaagcagctgaaacatgatcactgtttctttagttgcagtaaggctttgattattaactctgatttacatataacctagtatagtgtcgattgcttcctctgtataatgaaccagagagaactgggacaaaatatttgacactaaattttgtatttcttctttggcaatcaaattggctgtatcaggttcagtgctagattttcttttgctggctctttgaaggaacgtacctgttggatctttcatatgttgctgataagcaggttcccatgtgaattcaagatgagcaagttcattttgcttagaaaatgcaagagtcatcagcttttttacaatcatgtaaaccatatcctctgcaatatcactcatgttctccaaagtatatgtcagtgaagcttttaaaggattttcttttggggaaatgaaatgttctcctctagctgatttaaagtgtactgacacattttattgtgaaaatacctcaatacatttttttctgtgaacttcagaccagcttctcaagtatgttttccacaatgtcagcagccgctgaagagatatcaacattgcagagcaagtcttctttgtcagtttggtcaacccaaacttcagctgtaacagaggaaagagtgggtttggcctgagttaaatcagacaacacttctagaaaaatgccatctaaagtcaactcagttttctcttttaggtaacacttaaagttaacaaaagcattctttaactcctgcatctcatttatggcttttgcttttccaccagaaatcagtgggtttttttttttttttttttttttagacggagttttttgctcttgccgcccaggctggagtgcaatggcgtgatctcgactcactgcaacctccgcctcccaggttcaagcgattctcctgcctcagcctcccgagtagctgggattacaggcgcctgccaccacgcccggctaatttttgtattttagtagaaacggggtttcaccacgttggccaggctggtctcgaactcctgacctcaggttatccacccgcctcggcctcccaaagtgctgggattacaggtgtgagccactgcgcctggtgaagtcagtgggcattttaagccatccgttttagtggtagcatccctagatttctttgtgcctgtttccatcgatgtgataaggtgactatcgaatttacagattttgagccggaggtatttatagatcttattatgtttaatttcagaggttataggttgtcctttcctgtgatgaattttttccacaactgttgtttctttgtgggcagaaggtggcattaaaagtgtgactggtcgccccattgacctgtcaggtgtctttatataggacactgaaatgtcttaattgtttcaatataaacatttcactgcatgtgatacaacaacctgaactatctgaaaagagagtggagtcagcagacattgggtatgtactattttacaacatttcttcatattttgtgattgctgggtataatatactggtcactgctgccacaattcatgtcattgtattatgaattatacttttcagttcttcagaagttacctggaaaggaggtgagcagggatacaaagaaaaccaaatgtaaatttactctattctagggatgggggctggcctttaattccatatatcaaattacagttagtcatggtatatagaaagggatctctttagaacatcagattaatttcaaattggtttattctctaagtctgtgatctattttttgaatatgattctctttgattcaaaggcacttgaaagttttatttttagcatttactactggggatcaatgactttctggaagaaaaaaaaatagccaagtgagtgtctaggctcatacaaaaccagtgctttggcaagaagtaaaaattgtgtttatgatccaggaaatatttattaaaaatatgaactagattacttctaacaaactgtattaggctatttttgcattgctataaagaaatacctgaagctgggtaatttacaaagaaaagtggtttaattggctcacagttctgcaggctgtacaagcatggcaccaacatctgctcagcttctggtgaggcttcaagaagtttactatcatggtggaaggtgaagggggaagctggcatatcacatggtgagaacgggagcaaaagagggagtgggggaggtccaaaacttttaaacaaccagatcttgcatgaactaactgagcaagaactcactcatcacaaagggatgctactaaaccattcatgagaaatccacccccatgatccagtcacttcccaccaggccccacctccaacatcaggaatcatgtttcaccatgagatttggaagggacaaacatccataaacatccaaaccatatcacaatctatttcatgaagcaaatttgtagtcaaaatatttaggtgcttttgtggagatagcatccttctgcttaggcatctgtttaggtaggatatgagggcaaaaaataaggtcccctagtggcagatgtcagcccgtgactctgctgtcttcctccttcaaatgactgtttatatatgcaagcaactacagctaattgttgggaattaattgatgggtgacaattagcactaatgatttagggaggatcaacagctttgggtccaataaaatattatcagtctaaactttcttggatagaaaggcagaagacagatcatgaagacaaaaaacacattaatttaggtagaaaaagaagggctgagttggaattgggactcaaagagccaggaaggctaagcagcagagggaagttggggtccatttttttctgagctgaaatataaactcggtgaccaaacttgatgaccatttcctcagtgattaattgtactgtcacagcttatactggcccaggggtagatgcaaagtgcatctgtagaactctgtgttctctgaaagggcagtatgtgcgaattgacccccaaatgccaaggagctgagaaaccaaagaaagaggcagaaaaatccagtttgtcgatttggggtgatttattaagggaacttacagacagaatcgtggtcttgagtggtcacaagacaagtagatctccacaccacaatcccccagacccagggcttatatcttggaaaaaaagcatacgttctctggaatgaatgtgtaagtggtatgagcatcccagccaatgatttctgcaacaagagttgttttggaggaaacctacaatgaataggtgttcctacataaagggtaatatatcaactagacattttgggggcgttcttggactcttggggttagtcagaagttacacagcaggttagcatttaaaataaagtcactccaaaaataagcaagggggaaaggattccctatttaataaatggtgctgggaaaactgtctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgtacagcaaaagaaactaccatcggggtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggacatgaacaggcatttctcaaaagaagacatttatgcagccaaaaaacacatgaaaaaatgctcatcatcactggccatcagagaaatgcaaatcaaaaccacaatgagttaccatctcacaccagttagaatggcaatcactaaaaagtcaggaaacaacaggtgctggagaggatgtggagaaataggaacgcttttacactgttggtgggactgtaaactagttcaaccattgtggaagtcagtgtggcaattcctcagggatctagaactagaaataccatttgacccagccatcccattactgggtatatacccaaaggactataaatcatgctgctataaagacacatgcacacgtatatttattgcggcattattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaccaaacaccgcatattctcactcataggtgggaattgaacaatgagatcacgtggacacaggaaggggaacatcacactctggggactgttgtggggtgaggggaggggggagggatagcactgggagatatacctaatgctagatgacaagttagtgggtgcagtgcaccagcgtggcacatgtatacatatgtaactaacctgcacaatgtgcacatgtaccctaaaacttaaagtataataataaaagaaaaaaaaaaggaaaatgtggcacatatacgccatggaatactatgcagccataaaaaaggatgagttcatgtcctttgcagggacatggatgaagctgcacaccatcattctcagcaaactaacacaggaacagaaaaccaaacaccgcatgttctcacttgttaagtgggagttgaacaatgagagcacatggacacacggagaggaacatcacacgctggggcctgctgggggttgggggtgctaagggagggatagcattaagagaaatacctaatgtaggtgatgggttggtgagtgcagcaaaccaccacggcacatgtatacccatgtaacaaacctgcacgtcctgcacatgtatcccagaacttaaagtataataataataaaaaaggaaatataaaaaagaaaaagaattgtcatcaatcttgaaaaataaaacaaaataaaataaagtcactctgtccacacactctctactggtttatgtccttttactcattgcagatatattttggtaatataaaaatccctttgcgtatcataaaatagtatgtttttaagttgttactctcaaaacagccagaacaagagtctttaccttccacaggaactgtacttctcaaggctgtagatacaagtcagtggcagcaaaggctggatgcctagcatttgagcactaggagaatgataggatccctataatgtggttgttgcctcccccacaattatctccaaagttagctctgagattgttcaggtttaggccaacattcaaagaaaatttatcaccttgctgcgtgtaacatactctcttttgacccattagagggttgagggccaacccagggaagacttattttattccactctaattcccaaatgccttaattcatattttgttgcatgacataaaatttaccattttaccattttaaagcatacttcagcagcattatgtacgttgacaatgtcatgctaccattgctactgtctagttctttcacagcctttttttttttttaaccacagataagaaagcggcaataagtttgaaaaacatactttgggatgacagcatatggttgaaaacacttgttttacataaatatgtcctaaatcaaacacctctaagaataacatgtaaacattaacggggaagatacttaccttctgtgtctaaattggcctaaatccaatccattccaatagatatgagctgataatttcaatatgtattatttccttatgaccacagatcatgtacaacagacctacattcttatgcttaggatagcattcctaatcttaatacataaaatagggacattcttaaagtttttaatgaagtgaaatgtgagaaatagaataggatttttcagcttactttcactataccactagaccaagaaatatctttttggtgccaattttgtgcttgttgcacagtctatgaattgaacagacatatgtgtgagtatgccacttccctgaacctctctttgttcatgtttgatccatccagccccagagttgtggttcatcaaattcaccttcttatttttgcttggtccacgttacagctctcaggtggccaggtcatttcttttggtggtgtggccaacttaatagtcttcttactcccaggaaaataaagagacacatccaaggcaccctggctcacccacctcaggggcaggacgctcagccctgagccaggtctgctgtggtctgcaaagggatttcccttaatgacttcccattatggagtaggtttgtgatattcaatgcttttcctgttctgtctggacctcctaaggctccccaaactacccctctgagcccccttgcccaaagggccaatactctttttaacaataactttggacccctgtaaaacctgagattaactgagattgaaagtcatggaagagaaacaggcaaagagggagactgactaatgtcaacagatgatggctggctttctgattcacagattttttttctcttataacatatttgaaaaaaaacttaatatattgttttcaatgaatactttttcctgacagggattttgatgaacagatttctatggacatgttgctctacatggagacctgctttagtatcattatccagaaatattcattaaaatctacttatgaggtggggagtggtggctcacgcctgtaatcccaaaactttgggaggccgaggtggctggatcgcttgaggccaggcatttgagaccagcctggccaacatgatgaaaccctgtctctaataaaaatacaaaaaattagccaggtgtgatggcttgcgcctatagtcccagctacttgggaggctgagggaaaagaatcgcttgaacccggaaggcagaggttgcagtgagccgagatcacaccactgcactccagcccgggtgacagagtgaaacgccatctcaaaaaaaaaaaaaaaaaaaaaccgcttatggtactagatggcatacaaacatgttagaaagtgttagagtaggaagagattaataacatgcagactaatgaacaaatattgagcaaacatatatatatatatatatatatatatatattaaataattcattcaacaaatcaatgccattgagtgttactatgtgccagacactgtatggtcattccaatataacataggaagtcctataataaaggggtatatataatgcttcaggagcagtgacagagggtgtctacacagattgtgaggaaggttctctggaagaggtgacacgaactgaatgaatcttaaaggataacacgttttaaagagggacactcaagttgtagccaaatgaaatagtaagggcaaagaccctgaggtgtaaataacatgatatgtttagggaattgaatgtcgttcagtatctctggagcacagaatacatgtagaatggtctagagattaggcaggtgaggtaggcagtggacccagattttaagatgtattttgtgcctcactgggagtccctggaggatttgaaacaaagcagtgacagcaaggaataaggacctagtacgatatgttaataactattttacaagtaggttttgaagaatgccaacaaataataattttctttttctgtctgaaaatctatctgcagctcagagaattgtttcttctcatgattcatcaaataagtcagtgtctaatttggattagaacatagaatagaatattgtgatacctagaaaagggctatatctaatttggtatttaatatgatcagaaaatcacaattttaattcatcattattgaataatcatctgtagattctttcccactgtgggtcagagagaggagactaggagttttgaggaggtaggtagaaagtgaatgatcagaaacctctgatcaagcagggcaagcagaaaagactcgcccagccactccactcttcttacaaccccatgctcttcccagctcactacaaaataaatgtggctaagtctaagttggatcaagagtgtaatattagaatctgggagaatgttccaaaaattattagccctaaattataaaatcaatctctcttgacttttcagacatcaaaactgccatcaaaatcactgtcaagaaaaattatgtatgatgaaattcactgaaaaagtaacatattaagttcttttctaatgttaaaagagaaaaatctgtgacattagtcagtctccctctttgcctgtttctcttccttcactttcaatctcagttaactttgggtttaacaggggtccaaagttactgttaaaagagagtattggccctttgggcaaggtgacccagaagggttggttggggagacttaggaggtctagccaaaacaggacaagcattgaataccacaataagaatgctctgaataatggaaagtagtattacaaattagagccagttcaaaatcaaggtgaattggtatttatttttctcccaataaatataaagtgtattgtgagtaaccaataaattccaatgatctgttttaaaagctttacttaaattctatataactttttgagtttctttgtgtacgtttttacgtgtgtttggttttgaaaaggaaggagctggaattagtagtatgcaagcctgagaaatcaagtgtgaagataatactgttgtggtggttttagagtatgtccacaaattcttggatacttctccctgcaagggtggaggttaattctcttcctcttgagtgtgggctgtacctagtgacttgcttctaatgaatagcatatggtggaaacagttgtgtgtaacttcagagataagatcataagatctactgtgacttcaacccctctctcttggaacacttgctctgggagaagccagctgccataatcatgcggctactccagaagccctatagagtggcccatatggtgtggaactaagacctcttgctaacagccagcaaggaattgagaccttctgccaatagccctgtgagtgagcgagcttggaagtgaatcctctagtcccagtcaagccttcaggtaactgcaggaggccaggatgataccttgactgcaacctcctaagacaccccaggtcagaaccatctagctaagctgctcctatattccggaccaagaagctgtgaggtcattttttttttaaactgccaagttttagggtaatttgttactcagtaataaatatctaatggaacttctgaaaaaaacatacctccatggtttttagcaattggagaattaaatatcctgaagaacctaaatgtgtaatacctactagaaatacaatgggaatataatacaaatacaattatggtggagaatgtcaatgcacctcgttgatggctggacacatctagtagacagtaagaaaagatagtctagtagacagatcagtaaagacaggttaattgaatagtataatccataaatataacttaatattcatttagacttttatatactttaaatagagaatatacattttttgtatgtccgtgaaacactttcaaatatcaatcacatatttagccaccaagaaaacattaacaacttcggtatgctagagatttccaggctacattctctgaaactaataaaaataatgtgatgcaaaataataatttctcggtaataaagaaacatactatggacaactctcagatcaaaaaagaaattaaaaggggaaagtataatctacctgaaaaattacaccttatattaagatctatgggaaataacaaaagctgtttccatgggtattgatataaagtgttcttttcattgtttctctcatgagtctcagaccagtttctccaactgcctgtttggctattccacttagatgtcctattggatgcccacaggcaccttaaactcatactaatattcaaagctgaactaaatatttttcttccaaaagtgttccccttgctgtattgcctatctactgaatggcaccactcttcactatccacttagttgcccagtctaggaatctgggtgttgtcttcaactccttcattgcctatattcaattggacaccaaacctcagccattcgacctccttagtttaagtcagatctgggcccagttctctatcctcattgccaatgcctttgttcaggagtcatttctcactttgactattgtaataccctttttaattgtagtaagaagcgtggtattacggttaggattggttgagtgagaccgacatgggttaaaactctggctttgccacatgctgtgtgactttgggcaagacaatttaccaccctgagacttcgtttgcttatatatagaatgatagataaaaatagtagtgacttcactaaattattgggagagttaagtgagagaatataaagggtttacatggtatctggtacacagtaagtgttcaataaatgctgttattattattattgtttctttcctccaatttctttacttctaattccattttacctcttctgaaaaggcaaattctgaccatattatttcccatgctgctttttttgtttgtttgttttgactgagtcttgctctatcacccaggctggagtgcagtggcgcaatcttggctcactgcaacctccgcctcctgggttcaagcgattctcgtgcctcagcttcccaagtagctgggattacaggcgcctaccaccgtgccccactaaattttgtatttttatagagacggggtttcaccatgttagccaggctggtctcgaactcctgatccacttgcttcagcctcccaaagtgctgagattacaagcgtgagccaccacgcccggcctgctgatattttccagtacttgctcttgattaacaggataaaaggtaaatgcttgtcatggcctaccagaattttaatgaccagtccttatctaccagtcaagcttcatcttctgcaattctctaacttgaacttttaggtaaaacaattctaaaacaatttgtatttccacaaacacatgctttaatgtctatatcttggtaaatatattcccttttcctggaaggttctctctaccaccttccatttgtttgcctagaaaattctttttcatccttcatgtctcagctcaattgtggcttcttctgtaaaagcttccttgtgcttccactagattttgtacatatctccagtatgcacttatcatattgggttgtaattattgacatgactgttccccactaaactgtaaaattccagggtagggaccatggcttttctgctttgtatgttaaataattggcacagtgcctgtcatgtagcagatgctcaacaaacgttagttgagtgaatgaattaaggggttgccagatgtgcttaataattgttgctaatatttacctggttcatagctgaagcttggtttcttgggcctttttacacttaaatcagcatgtctcacctatatataccataagaaaaataaaaacaataaaacaaaagttccccaaggagtttttaaataatgtgaacactgggtatttttcacatttaaaatataaaactttaagaaagtgatttaagaacttatttcaaaagctcatttataataaatatccatgttttatttggtttatatgacatatgctatttgtagaactgaatttgtagaactcaaaggttcatagaattcattggtattctaaaattaactaactgtggaatcaccctgataagcatggaaggtaatcaactgaacagctaaaaagaatatgtgtggcttttaaacaaagctaagtataggagagacatttttagagaactggaaggcagacagcaggttaaaatgtgactctttggcttggccaagaactctgcttgctttggtgattgtacaggtagataaatgcaacaaagtcgactttatttttttccacatctgagagctggacacaagccaccagaagtacatttcctaacactgataggatgggtgaaacaagttggaaaatagtattgtattctattgtaataaaggtgtttatgctgtttctcaaaataatgagagatatttgtgaccatttgatgtacttattttgcccaacatatttcaaagtctcctttaaaaactggtggtctaaatttgtttattgatattttttggtaaaaatatgtaatattaggcttgccatccatgttaaaataaggggacactttttcctggctctgtattgagaccagtgaaaaaattaactcctgatttgcaactactaaactatctcaaagtagttaagtttcttcctttagatactgaacatactgattatccatgttgacttagtagcacaatgccttgcacatagcagatatttcataaatatttgtttatacagagaagcatattatggcagacatgctaccttttagccattacacataagcaagtctgtcacttagtatgcaattaacacaggatatgccaatgacattttctactttagttatctaaaactcttttgggaagacttcagtaaattacctgcttgatgacgtctctctcaaaccatgttacctttttagaacagcaaaatcagttaatacagtgctaacagagccaacaatgtggatttgattcctataataatcagttggtatcccacagagacaatctatgctgtgacaaggggctgcgccatgaatatctgctgctaactttacagcattagatgactaaggactggtaaccaaggggacagaatgagacaatatggctgtctctgcacaacccatcagcactagaagacaagtgattcacaaaaacccaatttgatgcttcatcttcagagcactagtatgtatcttgaagttcaagtagctcaccagttagcctataacctaagggctattaagtgggaacactcaagttgcttcaggtaattactattaagaatgaaggcaaatataacattcaaatttgagatttgtctaacaaatctcaggcccaccatctttctttttctaactgacaaattgttactggtattccctacatttacagcttggtgacattaacataactgatagccaccagtgtcagtagactaaagtagcacagggctattactggggtttgcatttcaatttttgtaaaaccttactttaggatggttaatttcagggaataaggctgttctaaattgacatttaatgaacgaagttgttgtacaccaatcttgatcataatttcatacttcatttgttctatctacatctggtacaaaagaaatgttacttgcctcttgtctcagaatatctggtaaagattgtctggggacatttgttgttttagcagaaacaactgaagcatgaagtgaggcactttttattcctggggaaaagaagaggtactattaaattgagaaaatgatatagttctccttcctgggctgccataatgtctggaattaccatagtcaaggatacatttattccggttaaggcagtagctccaaggataagatgacttgatgaggtttttaaatttcccctgcctacaaacttctagtggcttgccacttacctcagggacaagtctgaactccctaacttcttgctgtaacttcctttgctagctttatctccctcccaatgagaatgaaatattttgtactttattcagtagccaacagctaccactgaggacttttgagtagagggattatatgccccaaactgtattttggaaaggttacattcacagcaaaatgtagagcaggttaaaaggaagaaaaagaacatataatggagtactattcagtcataaaaagaatgagattcagtcatttgcagtaacatggatgggactgagggtcattatgttaagtgaaataagccaggtacagaaagacaaacatcacatgttctcacatatttgtgggatataaaaatcaaaacaatttaactcatggacatagagagtagaaggatgggtgaccatttacaagaggctgggaagggtagtgggggtggctagagcggaggtggggatgtttaatgggtacaaaaaatagaatgaataaataggcctagtatttgacagcacaaatgggtgattatagtcaataataacttaattgtacattttaaaataacttagagtgtaattggattgtttgtaactcaagtataaatgcctgagaggatggataccccattgtccatgatgtgcttatttcacattgcatgcctgtatcacaacatctaatgtaccccataaatatatatgccaactatgtacccacaaaaattaaaaaacaaaaaataaaatgaaaaggaaaaggaaacattttactgaaaaaaaggaataagaagacattggaggcaaattatggtaatcattaagggcagggataacatgaatggaaaggaaaggtaaattacacagaatgtggcaactttaagatgtagaatatgagcaatgggaaaaagcgaaagatgagccaagttttgtgcctggataaaaaaggaggaagtaagaacaggttttggggtgactggaagatgatgaattttgttttgtgcatattagatttaaagtgctcaatgactacccagatggtgatgtcctagtgtgcctggtggccgtgggtatgtgtagaatatgcatgggaatcttctgtagggactagcagagacttagctaacctctagttcagccttgcggagatgggaagcaggatgtattttcatgtctgaggagaaggatggcagtagaaggtagggacctttttggggagaattttctgcactgggactcccaaatcatactatgttatgaacttactctgcctatcagtaagggcagccattgcaggaactctaacttctccacactttgcaaatcccaaatgacctattcagctaaaaaacaccccagtatgtaagataataacattcataatcatgaatatttttaaaatcttcctttactaaaaataagcacagattttataatcaggaaaataaccagctgtatgacaaaactatttaattgaaaaactacagaaaaattatgaatattatttattttcttacctccttcatttgaaggacatgacagtttagtcatttctttatctttctatatggcttagtattccagagaaaagcattaattagtaattaagcttctattattattttttcaccctgcatgtggtatctgataattaagcttctaaaagagacttttgcctactctacaggcatcaaattaatataatatcttcccctcatcccctacctctctcccaagcactggtctcaatgctaatacatattatcaaccacttgctggacatctctcacagacacctaaacttaactagctcattatgtacccatggactcacatctttccaaattcacttcccttcctgcagttcatattttagttaaagatgtggtgattcacccagtgctccattctaaaagttcagatttgccccgtttatttcagtaaggccactccaattcaatctaatgcttattgggtgcactgcttagacctgaaaaaatatatttaattcctgacctcaagaagcttatcatccagtaaaacagtcagacaaatatgatacagtagaatgagttctgagacagaggtaagcctaagcaccatggaagcacagagaaaagacaccctactttgtgaaaaacctatatacaaaaactgaataatataataataataataataataatcatcatcatcatcatcctcatcattgatatggtttggctgtgtccccactcaaatctcaccttggattgtaataatccccacgtgtcaaggtggagataattgaatcattggggcagttttccccatactgttcttgtggtagtgaataagtctcttgagatctgatggttttataaatgggagttcccctgcacaagctctcttgcctgccgccatgtgagacacgcctttgtttctcctttgccttctgccatgattgtcagacctctgcagccacgtggaactgtgagtccattaaacctctttcctttataaattacccagtctcaggtatgtctttattagcagtgtgagatcagactaatacaatcatcatcaatctccctctcagactccacacatctattaagtcaccaactccagacatagtctaactccaaaatatcttgaatctatatcttccctttcaccctcatgctgctgcctgtttgggcccttatcatttttatctgaactatcccagttcagataaactgggatagttccaaactatcttgtctccaaactatcttgtctctaatctcttttctctaccatctatctcaaacactgcaactggattatctttttagaaattcaaataattcttatgtcatatgcctactcagaaaccttcaatggttccctgctactgagaggatatagtcatacttcagcaaggtgtacaaggctctgacttcaactcaccttttcagtctcatctcctgcacttctctggctatgctggctcacacctccatgctttcaatgtacgcttttcacttgtatctgcaacattggctcactatatcctcacaactactcacctggaaaattcccactcacatttcaggacctaatttaattaaatcctcctttaataaagccttcttcaacctctctaggcaggactaggctttaaatcttctacactttcactacattttgcatcaatcaaaactcccattttattataagaacttttgtttatgtaagtctgacccttagaaggtgattatgtcttttccatctgtatattctgtgtcacccactttttcctttttccttctttctcacttagtacaggacctagctcacagtaggttctcaacaaatgttaactttcatcatcatcatcatcatcaccataatcatcatcatcatcatcaaatgtttaagttactttctgctaaattgcgtggtacatttagcatgaagcttactcagcaccttctttaccagggagaggggtgtgacctgtgtcttaacacaatgatctctagctagtcagcaccaagccagtgaatgggatatcctatagaaataagttaactagacaaactaatgatcaatacaaacatttgaaacacaatttcttctttttgttctgtcgtgttactctatacattccatcaaggatgtaattgcttcttcactttttgatagcaatcttggtaccattttgagaatgatgaactggccctaaaagtaagtaaaagggaaatcatatcatttttaaacaactttgttaaattatgattgaagtacaaaactgtacatgtttaaaatgtacaatttgttcagttttgacatatatatatacatacatacccatgaaacaatcactacaatcaagatagtgaacatactgatcacccacaaaagtttcctttgccctcttatagttcatccccctctgtactgtcccgcaggcaatcaccaatcttgctgtcactataaattagttcgcactttctagaagtttgtatgaagggaatcaaacaagatgtactattttttgtctgtactgttttctttcatttaacataattattttgtgattcattaatattgttgcctgtatgagtaattcattcctttttattactgcatagtattccctggtatatatgtatcacagtttacccatttacccattgaagggcatttaggttgtttccagttttcagctatgatgaataatgctgctatgaacattggtgtttgattctttatgtggatgtataatttcacttctattgggcacatacctaggagtgtaatgactgaattgtgtggtagatgcaagtgtaacttcatttgcccaactattttccacagtggttgtgccatgtttacatccccatcagctgtgtaagagagttctaggtcctcttggtctttgcaaatgcttggtatgaacaagtatattctagccattttactgaatgtgtagtggtatctcacagtagtttaatttgtagttccctgatgagtaataatgttgaacagcttttcatgtgtttatttgccatctatacgttttcttcagtgaaatgcctgtttgcccctttttatgagattgtcctgccttttgccaactttataacattgttgcaaaaatattatatgtattttatattctacatctttttacaatgagaatgtattctagatgtaggtcaggaggcccatatttttcctgtgcttacctttggggcctgacagatgtgaaataaccattgtgcaacagggctattatttcaaaaattttatatcatttctaattcttgactccttcggtactctttatcctagtcttccataggcatctactggtttggtagtggaggtaggggaggtagagtagagaagtctactcaataatttgtaacaggaggaattccatgatacacaccaaggtaatattcagcacctctcatcccaaaataggatgacacaacaagacagttcccttgtaagccatgattgtctcaagaatttccctaaattttttccctgttttgtgtagcaacaacctggaatgcttagctactagagatagccttgccaccattaaaggttatctggggtcaggaagaaggggtatatgacctaggagaaaggtaccaaagaaagatcactcctttagaagctcagagatagtaagaagatggaagagtagtgtcagagagaggctggagagcaaagaaatcagatgtggcttcacatttgccttattctgggccttggttgctttagataattgaagttaacatggagagcaaacaaggggaactatagctccactctccatttaagactctaggaagatagatcttaggttcccccagtccttgcttccaccttttcctcacctgggccatggcccagcaacttggcagtatagtgcagtcaggcccagcaaggttctctctgaggttttggtttcttaagccactcttggttcccatgtggtatagtcatggtccagaaggggctgaaagtctagctggggagctggccagggggagtcactatggtggaagtgagaggactctaccctgagtgttatagagaagccaaccagaattggggtgggggatagacaagaaagccagagggctctactaagcccagggagaccagagcatgagtcagtacactagtggcagacttaaattttgaatgccagtaggctaagcgctatctgagtggagacagaaacatctgtttggagacccaaggaggcagaggacatttcgtctaagcaccctgactttgttctgcctttatgaggtcatggaggccagtgcttctcaaacttgaacatgcatacccacactgggatcttgttaaaatgcagattctgattccgtagggctggggtgaggcctgataatctgcatttctaataagcacctagatgatgcccatgtggctgacgcttagaggagtaagaacataagtcaaacctcttacctcaggcacatggacgccatctttggaaaagaagcagtaagatggggaagcttcctgaaagtctgagccattttgggggctccacaaaggcagaatctaaaggagtatgttaggaaaatcaatgactgagctagaaagcaaaacaaaggaagacacttcaattcaacaaatagtgccagccctacatgtgttcaggaagcctactaaagaagcgggttgaaacattaaatgacagctactactcaggtggggttttctaaaaggaagaggggaacaagagtgggcaatactgggggcacactccactgctgcagaaaaatatgtggcagaataaaatatttctgctgccagtgaagtgacataaattacttttgggcccgaaaggtcccaagtcaaaggaagggcagggttttgagcaagacccatgtcttggtcctcactaggtccctagtgctgtggttccattcagcaatctgcaaggatagttctccaggtggaacaagtgagatgcaggtaaaaaacttccgtaggaggtggaactgctgagaaaggggtggcagcagcagtagcagcagctagtgatgcacaggctgaaaaaaatacctcagaatcttgttgggaatggggaagtacagaggagagatcagaagcaggggctgtggaaaactcagggctctgatcatgcttggagagttgtcaactgcaaaatgtgggctgccctgctcatgggagtgtggaggcagtgacaccaactgagtagttagggcatctaatgcagatggcaatagaagctgtagcactgttggtgagaattactcaaaatccatcatttgatagacgagaatagaggatttatctgcatgataagcaggtcattaccaaatccagtctttccacaaattactcatttctaatgataacatttcaattaaatttttgtccttggtgtggtttctgacccatgggagtgtcactcattttctttctctttgagggagttgcttaaagaaacataatgaaacatttatttttaatagtggggatgacaaaagtatcccagatagattctattcatccttccatgcccaataagaggagagccatatgccgatctacatatggggttgtggcggaggaaatgggagatgacaggcagtggttctcgatgggaggtaattttgtcctccaggggacatttgaaaatgtctggagacatttttgattgtcacaaatgatgggtgttgtgtttctggcatgggtagagggatgctactaaacatcctaccgtgcacaggatggccctccacaatggattctgtggccccaaatgttaatagtgccaaagttgagagaccctggggtagagacgtgtgatgggaaggaaagaaaattacctttagagctgcgcgccgcggcggcggaagatggctgcggccgagttggcggacactcagctgatgcttggagtcgggctgatcgaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaataattgaagttccagattcttccattttgaaaaaggtgactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacccggctggctccatcaaagacattgtatctcagtttggaatggaaactgttatcttacacacagcactgatgctaaagaaaagaattgtggtgtatcaccccaagatagaagcggtccaggagttcaccaggactctgcctgccctggtgtggcaccgacaggactggaccatccttcactcttacgtgcacctcaacgccgatgagctggaagccctgcagatgtgcacaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcagaagatccagagaaatcagagagccaggttatacaggatattgctctaaaaacaagagaaatctttaccaacctagcaccgttttcagaagtttcggctgatggagaaaagagagtccttaatttggaggcgctaaagcaaaaacgatttccaccagcaacagaaaacttcctttatcatctagcagcagccgaacaaatgctgaaaatctgactgtgtgacagaacgtatcactgatgactgatagaaagccctctttcactctgattacccactcactacatgaagtcctgaaaataacagagaaactgttatatctttttaatgatttatttgcaagtattgagatttgacctgaaaaacaatgaaacacatgaacacacttccgattttctcctcgctgattagcttcctgcctgctgtcagtgctggacgaagtgctataactactttatgtaacattacagaacagctagaggtcctggggtaagaggaaaaaagcacatcacgacaaatgtgaaagccttcattattacacgttccagtttgtctcgctgtgtaggcataagctaatggtttattttcagaaagctgcctgaaacgttgctttgtattcttctaggaagaactttaatttctcctgaggaactctactttctgagccaaactgctaattttctgcggaactgtctagaagatcattcaagagaccctgcagttgcactttctcgtaaaagttaaaaaaaaaaaaaaaaaaaaggtttttcccggcctttgaacattttgcctatgagagttttgcatatattttatacttgagtagacaactttaataatccatatttatactatcgcagaagtaagcatttggcaaacgttcagccattagcactcatttaaccctgttagcaatattcttttgaaaaaagtgccagtccttatgtgataaactaagaagcccattgaatataaaagtgtgtaggactgaaacagtgaccttatattattgctaagggaatatgagattaacttcctacaggggccaaaaccagagaaaggcttccagcaacttcagtgaaagtagtttggccacatgtcaagccaattgtttgtattatttatgtacctttttcataactggaattgccaaataagcatggaggtctaaatgatgtacttgttagtgtattcattcatattgattgtaaaggattatttttcactcagtactgatgtccttggaaatcttacctggaaacatgtttgcaaaaaacattattggatctttcatctttttcttggtattacatatttgttcaataaaaattaaacaccctcccttttttttgagtgagggcagggagtacctgaaataagacaatgtttactaaggcaaataattgaaaattaaatctgcactttatggaaatgagaaatattaacatcttttttctcatttttttgtattactgtattagctaatgatcaaagttgttaaaattataaatttatgatgcagaaataaaattgaaatattttgatattcaaaaaaaaaaaaaagaaaattacctttatactatcttgtctaattaaagctactttggctctaactagccagaattgtcttctgggagaagggaacaactactttctgttccatgagaacacggcctgcctctgtgtgggaggcagaccagcataataactgtgctggagatcctccaagctagcggcaatgacaattcttggttgttcctcacagcttgacagaggcaaccatataaccatatacatagacctcatctgggaaaaaggtgattacagctcctgtttttaaccatttagattgacaaaaggattcctaactgcatgtgtgctaattgggttttcattagagttttaagatgtgtgtcccttgtgtctgcatggtagaagatgacagccttgttatagtggatatgagtcagttgcatatgtgaaattgatatcctcactcttctgtcacctctataatatagtgaacttaaattcacttatattttctttttcaaaaagggtttgaggtggtcccggtataagatgcctacctgatactttctttctgctagaagtgggtgttaacagttgaaggttaagagccgtatggctgcttacatgatcttttatggaggaggcggaacattatagcctcattatttcactgaactgaactacaagcttgtcttattgactcctcttttataaaattttaattccttcttccctatcatattgtctattcttatcagcaccttcagcatctttttttttttttttgagacagagtctcgtctgtcacacaggctggagtgagtgcagttgcacaatcttggctcactgcagcctctgcctccagggctcaagcaattcttctgtctcagcctcctgaatagctggtactacaggcacatcactgtgcccggctaatttttatatatttcttttgtaaagatggggtttcaccatgtgtcccaggctggtctcgaactcctgacctcaagtgatctgcctggcccagcatctgaaagtgctgggattacaggcatgagccactgcgacagccaaccagcacctctttttaaaacattctcttacacatatccttcctcatttaattttttaaaattttctgctctttttctctttctctatccttttccctccctctttcttccttcttccctctttcttttgctttatttttccatcttttgctctatattttctttattgattcctcctttcagaacttattttttctttcttttctttctctcttgttttcattatttcttgcagtggcgtttcttatggactcttctttgttaaacatctttctctctctctctcttccactctttccttctctctctttctctttaatgcactatcatttttgtaattttttttactctccccttttcaccatcccctctcaaatttattttatcattgacttctcctttcaaaacttttccttttctcttttgtgtaaattcttcctacaggcttcttgcatttaagatttttcttttgtattctatttctatctttctttccttttctttttctttttctcttttttaatgcactttgtttttactggcccctttctgcttgtgaaactttctcttatttttttcttcttgattttactttcttattaactagttctttttaaacatttctttatttcttactctttcctcccttcattctttccttcattccttcccttattccctttgtttttcttgctcccttttatttatttctatttctcctccgttcctgtctgcatgcatgcccacctttcttccttccctcctcccttccttctgccttctttcctcccttttgcctttattccttcctcccttcctaccctctcctacattccctctttctttcactccagttactgagtcctttaaaaatgtttttcatttcctctctttctcttcttatctctttattttttaagtaccaatttttttttaagacagcgtctccctctgttgcccaggctggtgtgcagtggcacgatcttgctcactgcaacctccacctcctgggtttaagcgactctcctgcctcagcctcccgagtagctgggactacaggtgcgtgccaccatgcccagctaatttttttttttttttttttgtatttttagtagagactgcgttttaccatgttagccaggatggtctggatctcctcacctcgtgatccgcctgcctcggcctcccaaagtgctgggattacaggcatgagccactgtgcccggcctaagtaccgactttttaatggagttctttttaaaatcagtttgttcgtattctccctctctgcccgtcttacaactttttccctcccttcctatctagctgtcatccatctgtctatcttattttattgtcacattttaactgacttcttccttatagattggtctttccctgctgtccacagttgtacttttcttactagcttctctttttcaaacctctccgtgtctctcacttcttctcttttttaaaattttatgtagtctttcctacagattcattaatgtaaacttatttttctttccactccttcctccctttttatcttgccccttccttctttcttttcttccttcttttattacatttttctgccttttctcattccatttaagtccctctccatttctctattcttactctgcctacattccttcatttcagctttcctccctctttccctccctcccctgcttccttccttccttccattcgtttactggttcctgtttttaaacatttttcttttcatctatatcttgttctaatcctctctcttcgtatctttttttttttttttttttttgaaacggagttttgctcttgttgcccaggctggagtgcagtggcgtgatctctatctcggcacactgcaacctctgcttcccaggttcaagtggttctcctgcctcagcttcccaagtagctgggattacaggcacgtgccaccatgcctggctaatttttgtattttcagtagaaacagggtttcaccatgttggccaggctggtctcgaacttctgacctcaggtgatccacccacctcagcctcccaaagtgctgggattacggtcatgaatctttgtatctttttatacagtcttttatattgacttacacctttaaagttctatctgtctatctacctatctgcttacctaggtactcacctagttagctatcaatcattattttactattttttaaaaagtgacttctaccttttacatctactccccttcaacacaattgtacttgatttcttattggcttctccctcttactctcatattccttctcttaactcttttccctattgactcatcatttacactcttctttctttcttactttccatcctccttccttctttctttttgttccacttttacacttttactactacctcctcttttatatatttattttgagacagggtctttctctgtcacccaggctggagtgcagtggcgtgatcacagctcactgcagcctcgacctcttgggctcaagcgatcctccacctcagcctcccgagtagctgggactacagacatgtgccacttcgcccagataactttttttttatgttttgtaaagacagggtctcactatgctgcccaggctggtcttgaactcctgggctcaagtgatcctcctgcctcggcctcccaaagtaggattacaggcgtgagccactgcatctggcctgtacctcctctttttaaacatatttcttttcttccctctctcttttgggctactctctcattttgtcagtttaatatggtcttttcttttactggcttttgccttttaagatctgatctgtctatctgtttatctatctatttatctattcccctaatctgtctatcttcctgccttatgcctgctatccttcctgtctacctgtcgcccattaatctatctttattttatgctttcaactgacttctttttagatctctctcctgtcatccaattcctccctttcttctttcctcctttcttccttcctatacttttaaactttctgtcttttcttgttccatttctttcacgaattcatctctgtatttcgttctctgcctgcatgcctacatgatatcccttccttccttctttccatttctctatccaaactcccactctcctgtcttccttcattcattttcccttcatccttcgttctttttcctcccttcttccatctgtcttctccctctcattccttcttctcattcctcttttattctcaactggttcctcttttaaaacttttttactttctccctcctcgctttctttctaattctatctttttcatacattcttttttactggctgctgctttttaagttctgtctatctatctatctatcatctgtctatctattcaaccatgtatttacttatgtatcatcctacctacatatctatctatttagctattatatttctgtctttatgttgattttcctatctccacctttaaaatctgttccttaccacacaattgtatatgatttccttattggcttctccctttcactcccatattttctttattcctttaactcttttccctgctgactcatcatttataaacttccttccttccttccttccctccctccctccttccttcggtcctccttttgtttctccatccatactccctgacatttctccctcctatcttcactcatttctccctcctccttctcacttttttcttccttccctcccttttactttctttcttctatcattccttccttcctcccactgttcttttatgctctttcgattggctcctctttttaaacagtctcccctttctttcactctcattctatcctttttatacattctttttactcgcttctgctttttatgtttcatctctctctctctctctcatccatctacctacctgccagcccatcaacctacatattatagctatcaatcatctactttctttctttacatttgtgttttattttcctgtctccaaatttaaaatttgcttcccccaaagaattgtacttggttttcttattggctcctctgtctcattcttacattctttcttcctttaactgtgtttgctgctaactcatcttctataaatgtcctatttttccatttattttttaggatcagggtctttctctgtcacccaagctggactgcagtggcactatcatagctcaccgcagccccaaacttctgggttcaagtgatcctctcgcctcagcatcccaaaacaccgggataatgtttttttttttttttttttaatatatattttttagagacagggtcttgctatgttgcccagactggtcttgaactcctggcctcaagcgatcctcctgcttccacccttcataaacttttttccttgttcttaagcttgttcttttcttccttcctctctccctccccctccctctttctctcttttgctctctattttattcttagtatatcttttttatcttttatttcttaattcctttttattttgtgacaatatggttctctacctagatctactttattctttatatattttttgtattatgttttctttcttgtctcctttaataaattatttcattctttttctctcttgctttcattatttactgttgtggcatttcttactgatccttgtttgttaaatgtctttcttccctcctttctctctctatcatttttgtagtcttttcttacttgctcttcttttttacatctcttaaatttattttattattggcctttccttttaaaacttttctttttctgtttcttttttgtgtaaagtcttcttacaggttacttgtttttaaacttttcttgttctctgtctttatttctgtctctctttcttttcctttctcttttcatttttatttatttatttatttatttatttatttattttgagacggagtctcgcactgtggcccacgctggagtgcagtggcgtgatctcggctcactgcaagctccgcctcccaggttcatgccattctcctgcctcagcctcccgagtagctgggactacaggcgcccgccaccacgccccgctaatgtttttttgtattttcagtagagacggagtttcatcgtgttggccaggatggtctcgatctcctgacctcgtgatccgcctgcctcggcctcccaaagtgctgggattacaggcgtgagccaccgcgcccggccgctttctctttttatcttttttttttttttgtatagtttattcttattggctgcttcctacttgtgtaatgctctccctttctttctgtttctccctccttccttccttccttcttttttctttcttctttttctttcattctcatattctttattttaaaaaattctttaaaaacatctctttgcttcttcatttttacccctttctacattcatttttcccttctttatttcttatttcctttctctgtgtttttgtcttgctccctttctttatttctttttgtttctcctctgcttgcctttgttcttttgccttcttcccttctttatgccattattccttcctctcttcctgtcctctcctatattccctctttctttcactctctatttactggctcctttcaaaaacatttttcatttcctcttttcctttctaactttctatcttttatgcactgacttttttttattactgggttctcctttagaaaatctcccgctgtcccgtccctccctccctcccttccttccttccttccttcccttccttccttcccttccttccttcccttcttccctcccttccttccttcacttccttccttcccttcttccctcccttccttccttccttcccttccttccttccctttcttcccttcttccctcccttccttccttcccttccttccttcccttcttccctcccttccttccttccttcccttccttccttcccttccttctcttcttccctcccttccttccttccttcccttccttccttaccttcttccctccctccttcccttcctgccttccttccttctttcccttcttccttcccttccttcccttccttccttaccttcttccctccctccttcccttcctgccttccttccttctttcccttcttccttcccttccttcccttccttccttaccttcttccctccctccttcccttcctgccttccttccttccttcccttcttccttcctttccttccttctttacttccttccatcttcctttgtctttatacctcccccttcctatctagttgtcatccatctatctatcttattttactgtaatattttaactgacttctttcttaaagatttgtctttccttgctatccacaattctatgtaatcttatagctccttcttttcaagcccctctgcctctcattctttttttttaagttttgctctttcctacagactcatgacttacaacttctctttctttccatcccctccttcttttctgtcttgccccctcccttccttcttttcttcctttcttgatcaccttttcctatgtcttttctcactgtatttcacgctttctctgtctttgtctattcttaccctacctgcatgtcttcctttctttttttctttttcttttttgatatagagtctcactctgtcgcccaggctggagtgaactggtgcgatctcagctcattgcaaccctccgcctcccaggttcaagtgattttcttgtcacgacctctcgagtagctgggattataggcatgcaccaccacgcctggctaatttttgtatatttggtagagacggggttttgccatgttgaccaggctggtctcgaactcctgaccttaagtgctgggatgacaggtgtgagccactgggcccaacacatgtctttctttcttccttcctccctattgcccttcatccttcttttctaacctacctacttcctttctttcttctttgctttctccctttctcactgcctccctccctccctgtttcctccttccactatttcttttttaactattcctgtttttaaacatttttctttccatctctcttttgttctaaccctctctctttatatctattccatacagattttttgttttgttttgttttttgtttttttttttcaagaccgagtcttgttctgtcactcaggctggagtgcagtggtgcgatcttggctcactgcaaactccgcctcctgggttcaagtgattctcctgcctcagcctcccaagtagctgggattacatgcgcccaccaccacgcccagataatttttgtatttttagtagagacggggtttcaccatgttggccaggctggtctcgaactcctgacctcaagtgatctgcccgcctcggcctcccaaagtgctgggattacaggcgtgagccaccatgcctggcctcatacagtctcttatattggcacatgccttttaaagtcaaagtgaaagtttggaacagagacagttaaagaaattgagtgagaaaagacagaaaatttatagaggcaggcacgaaagaaggaggaaaaaagggaaaaactggagggagcaagcaggagatgttaaaagaagaagctagaccaggcacgctggctcacgcctgtaatcctagcactgtctaggattgtgtctatctgtctttctgtttatctacttactaaagtccttacctagctatctatccatctttattttactgttttttaaaaagtgacttctactttttaaatctcctccctttcacacagttgtacttgattttcttattggctcctccctttcactccatatttggtttctcctctttaactcctttccctattgactcaccatttgtaaatttcttttcttctttcttatttttattctatcttcctttcttcctcccttctttcctccctcccttcaagtctcaatttacactttttctagtgcctcctcttttaaaacctatttatttccttccctctccttttttttgtgggggggggtgctactgtctctttttattaatttcatatgttttttttttgttttgctggcttccaccattaagaccaaatctatctatctatctatctatctatctatctatctatctatctatctatgtatctatctatcatctctctatctatctatctggtccatctgcctacctgttttcctgccttatgtctgccatcctttgtatctgtctttctttatttcagtctactttcaactagctgctgctgctttttttttttttagacagggtctcactgtgttgcccaggctggagtgcggtggtgcaaacaaagtgctaagattacaggcgtgagccagtgtgcctggcctagcctcttcttttaacatctcttgcttgctgcctccagttcttcccttctttttcctccttctttcatgcctgcctctataacttttctgacttttctcactcaatttctttaactttctcttttccaaactttctctttttgttttctgcccccatgcctaactgccttctttcctttctccatacttctctccctttctccctttctcctgccccattcatccttacttcctgctcacttgcctgcccgccttccttccttccttccatccttcttttgttgccccatccatactgttttctctcccctcactctttctttctcattttttcataccttcttttttaaactagtttctgccttctctctgtctctcactcacacatctatctacttacttgccaacctacgtactgtctagctatctattcagctatcaatcttctatttttctgtctctatttttctgtgttttttttttggactccacctttcatcatctgtttgccattgcaaaattgtacttggttaatttcttatgggctcccctctctcactctaatattccctttcttttaaaaaaaatctgttttccctactgactcatcggttataaatgtcttccctccttcctaagttcctctcttcccctttctccctttctctctcactttacttcactctttccatctttttgcactaatttttgtattggctcatttcagaacttatttcattctctttctgtcttgcatttattattttttgcagtggcatttcttattgactcttccttgttaaacatctaagtttttctctcttcatcgctttctttccttctctttttcatattctttcttaattgctccccccactgttttttacatatttatctctatagctctcttgaatatcttttattgttggcaccttcttttacatttttcctttttctccttctcttctttgtaaagtcttcttataggtttctcattttaaaactcttctctcttttttgttctgtcaatatctgtctctctttccttttctacttctttatatctttttttcttatattttttggtatactttattcttctggctccttttgtaacaatagagggaggcttagcatgactgactccatttttgcatctgactccctgtggtaatttcctttaggttaaaagcttctgctcagctctgcatgtatgcctgctaattgtaggaggaatttagcttatagttctatgtcacggcatgttagaagatagtacaacaggccaggtgcagtggctcacgcctgtaatcccagcactttgggaggccaaggagggcctgtgccaggcctcactctctctttactttgcttgcctgcatgcctgcctgccttacttccttcctcccttcctccaataggtcttttttttatttgtttttataggcttcttttaaaactgttttctctacttctccatctctttctctctccttccttttttttgtcctgtcttttttactggattttcttttttaatgtcatcttacttgcctactctctctttgtctctttatctctgtctctctctcttcccaaccttctttacttattccatggtttctttctatattttcttgtactgcctttttttttattggctcttccttttaaaagtctgttcatattttctatctatacatctatcatttaacattactgtcttctttttaagtctctctttttccttactgagctattcttattgatttacccctttaatcttccattttctttgtgctttctctccttttctatttcccctctttttatttcactttttcttattcattttttttgttttagttctatatattttcttgtactggctttcttactgcttccttcttattttatttttctccgattttcttcttcctcccatatccttttcttttattcagtctgtcttcatcatactgcctcttcttactgctttctccttttgaaagtgtattctggccggacgcagtggcccatgcctgtaatcccagcactttgggaggccgaggtgggcagatcacctgagctcaggagtttgagaccaccctggccaacatggtgaaaccccttctctactaaaaacacacaacaaattagctgggcgtggttgcatgtgcctgtagtcccagctacttgggaggctgaggcaggagaatcgcttgaacccaggaagtggaggttgcagtgagctgagattgcaccactgcactccagcctgggtaacagagtgagactccatctaaaaaaaaccaaaaaagtgtattctacctacctatctttgttttcttttactgacttctaatttttaaaaatgacttttcatttttaatctgtcaccccctgccaaatgtacttgattttctaactggcttttcttcaaatttttctctcactttcacgttctatcgttttcattttattttttcctactgacttatcttttaaaacttctttctgttctatctcctgctctcccccattcctctctacctcacctccccctttcttgttcctgtgcctttttttctgtatgtctttttcttgctccctttctttcattttcttcctcctcccccaccctctttcagtctctcatttgtttctttctctttgttctccctccattccttcatccagagtgtgtgcttgtgttttcctactggctgcttctgttccattttctttctttttctctctattctctttctctccctctctccatttcattctttgtttctgcactgtcttctcttaccacttcctccttttcaacctttttgttcttactttttctctgtttcttgctttgtgtatttttaaatgtcttttcctttatattcctttacaacctttttctctttgtctcactaactctctctctctctctctctctctcgagagagagagagagagagaggagaaaaagagagaggagaaaaataagacaaaaaagagaggagaaaaggaagacaaaaaccctcttgccagcatccttttcaatccttgccagaaaaacatccttgccagaaaaactcatgtacagagggtttctctctctatctctctgcatacagacacgtgtgtgtgtatgtgtgtgtgtgtgtgtgcatgtacactctacacctggagatgtaactaagaagtgccttacatagtacctggctctaggaacatgaactcttaggacttacctttgcaagggccttgtgacctcactgtataagcagagggggtttttataaagacaacaatatttaatatacagggatgcatcttctatgtagccactttttaattgtctctctctctcaccttctgtttcatcttgtcgtttgttttcaaatgcactttcctctggtcttcatcttacaggtcatttttaaaacattgtttgtaaaaataggtaattgtttttctctagaagtgcttgtttctaaaatatttttaaaaataggctgaatgtggcggctcatgcctattattccacgactttgggaggcctaggcaggaggatcactcaagcccaggagttcaagactagcctgggcaacataatgagaaaccatctctaccaaaaacaacaacaaaaaaatatctaggtatggtggtgtgcacttgtagtcccagctacttgggaagccgaggtgggaggatcacttgagcccaggaggttgaggctacagtgagctatgattgtgccactgtactccagtttgggtgacagagtgagagcccgtctctagaaaaaaatacaataaaataagtaatacataaatatatatttaatatattttaaaagtttagtatcaacttgccactggcaaagcaaaatagagatttcaaatgtgatggtatatttgaagtgaaccctcaattcctatcttgacatttctaaagtcacaatgagtacaaagctagaaagataggggtaaatatccttttgtggtctagcatgaagaagaatatattttaataactaaatccaatttcacttactggccactttctggagacaagtctcatttcaggccagcccttgaagtataggttcaggccagaatgggtctatcagtagccttcttcatgagtttaggccatttcagacaattcacatttaaaaatagcaaaaatggccaaagcatttcctcaaacagcccaagtcattggtaaaagcccactctactaccttccagccagtttgtcctcaggttttctggtgtcattcttcagctcttgcttctctatttacgacttaatttttgtcagacacaacaggacttttttgccttccattcataaggaacacaatgttacagtagtcagcatggattctctttcataataattatttttagtatctactaccaataaggaaatttgagcaaatcaatggcctaatagaaatcaggtcaatcataatgaaaatcttgcattggctttaaatgggcttattttactgtgttttattgggaaagtgttggtagatgcaatggaatggcagtaggaaaacttattttgttattagacacttaattcaaacctaagctggctccaaaagtggattggaaaggatgctggcaaaaggattttgtcttctggactcggggtgtatggtgtgtgatctcatgttcttacatgtattttgacagggaaaccagacagatagtagccttgtgtgaatttggggcagtgagaatacaggcatgatttttttcactagagctaaattctaaaactttaaagagcagatgagatgtaactatactgtaagggatacataatttgtggtatcagtctcattattttaagtaaaagcttgggccaggcgcagtggctcttgcctgtaatcccagtactttgggaggctgaggtgggtggattacctgaggtcgggagtttgagaccagactgaccaacatggagaaaccccatctctactaaaaatacaaaattagccgggcatggtagcacatgcctgtaatcccagctactagggaggctgaggcaggagaattgcttgaacctgggaggtggaggttgcggtgagccgagatcatgccattgcactccagcccaggcaacaagagcaaaactctgtctcaaaaaaaaaagcttgtatattatcacagtgataaaatattaagaggacttattttttagacctgaaataacttcaggtaatatgataagactgctaaaaatgtttataaataaaacaggcagacagtttttcccttaatatttaaaatccagtgttactcacctcttcaatttgtctacagagatcaagatttcttcttatgtggtcctgtattgggggaacctgcccccaatatttcaacataggttctttctattttccataagtgttggccggctgagaaataaagagaaagagtacaaagagaggaattttacagctgggctgccaggggtgacatcacatattggtaggactgtgatgcccacctgagcctcaaaccagcaagtcttttattaagggcttcaaaaggggagcgggtataagaatagggggtagatcacatgcttcaaagggcaaaaaggagaactactgataagggtccaacaaagataacaaggcaaaaggcaaaaggcaaaagcggaactactgataagggtctatgttcaccggtgcacatattgtcttgataaacatcttaaacaacagaaaacagggatggagagcagagaacttgtctgaccacaaatttaccagggcagagtttttccccaccctaataagcctgagggtactgcaggagaccagggtgtatctcagtccttatctcaactgcataagacagaccctcccagagcagccgtttatagacctccccccaggaatgcattcctttcccagggtattaatattaatattccttgctaggaaaagaatttagcgatatctctcctacttgcatgtctgtttataggctctctgcaagaagaaaaatatggctctttttgcccaaccccacaggcagtcagaccttatggttgtcttccctttttccctaattctgttctttttcaaggtgcactgatttcatattgttcaaacacagattttacaatcaatttgtacagttaacacaattatcacagtggtcctgaggtgatgtacattctcaatttatgaagagaacaggattaaagattaaagtaaagacaggcataagaaattataaaagtattatttgggaactgataaatgtccatgaaatgttcacaattcatgttcctctgccacggctccagctggtccctctgttcggggtccctgacttcccgcaacagtcttcatatcgtctttttttttctttcatcttgagtacactctgctttcctgctgtgtccaatttcatataatcatatatcaatatctacataaaagtgcaaatattggctgggcactgtgtcccatgcctgtaatcctagcatttttggaggctgaggttgggggatcacttgagccgaggagtttgggaccagcctgggcaacatggtgagacctgtctctactaaaaataccaaaaattagccaggtatggtggcatgtgactatagtcccagctactgggaagttgaggctggaggatcacctgagctcgggaagttgatgctgcagtgaactgagagcatcccactgcactccagcctgggtgattggagtgaaaccctgtcccaaaaaaaggaaaagaaaaaataagtgcacaataagtgaaggtaaactgggtgttacccttacaatggcattgcctgctttgatattcccaaattacctgcttcattgtttttttatttcttgagctacagaaaatttaaagttattcaagcctgatccactaactcatcatgctgcactcatttttacctttgttgtagaattttacctttgttgtctttgttgtagaattgtctattattatggctaggacaatggcaaatgtgatacagagtgattgaaaacattttacatagaaattattcataactcagtagtttggggaacatgagtttctaaagatgattggaattaactgaaggactgactttaaaaaaacccagcagatttgaatttccttgaaaaaataagtggaggtcttatatatgaggtctatagactatcagcctgggattctggtggatcagtttgtattctggcatattgtgatgaatctatggaatataagaaccaggggatggagaactggcccttaccccgataaaggagaaagagaaagaattataactcatcctttcatttcccgaggcatgggcttgacttctgagtggtatcattgaatatgtgtgggtagtagctgaatgaacatacatagttggttggggaatgacacctgtttacattagcatcaaataaagttatagcaactttcctgttttgaccttgcagtaatttccttaaacttaagtttgaaacatatgctaaaggcaccttctctctccctctgctattgtagactgggtttcacaagatcagggatttgtattttggatttcttcttcaaacatcagttttgcttatctcttgggtttctagtggctccaacttcttaggtagaaactctcctccctattcttggtaccaaggttcccaatttctgtacttcttggtctggcttcctttctctgcatgttgaaaactacagggagccaggcatggtggccaacgcctgtaatcccagcactttgggaggccaaggtgggcgggtcagttgaggtcaggagttcaggatcagcttggctaacatggcaaaaccctgtctctactaaaaatacaaaaattaggtgggtgtggtggcatgtgactgtaatcccagctactcaggaggctgaggcaggagaatcgcgtgaaactgggaggcagaggttgcagtgagctgagatcaaaccactgcactccaacctgggtgacagagtgagactctgtctaaaaaacaaacaaacaaacaaaacaaacaaacaaaacacacacaaaaaaaaactgtagggaggttagggaggttaaacagtgtctagtacttttgttcgtcctatttttaattatttctagtattgatacaactttttgggatccacaatgtccacaagaattaggcattagctttcattatacctatgttttatgaaaaactattggtccagacctgtttgtgtaccttcctgtaatagccattcttgaaattgggcagtagcctaactgtcacaggctctctttgttttacataatttatttaccttttcaatcattttctgaaacataaaaaggagtaaagcctttatatttgccagacataaacctgtcctttgatctgtcttatgtttcaggcttagtaaacatcctatgctttgcaaatggctaattctgttagcctacatttaagtctagtgtggctccatttcagacaggtgaattttttttctctagaaatgaaagacaaatgtctcattttatcttttacagatcttttatagaggtcttagccttttgatttgttaccttaataaatacttctaggtcaaaatattataagaacatattctgcgtaggaccaaaccttacataaaacttttcttacaggccccaaataaacaaatttaagtatttaacttacttgttctcttatacagtttctttcaaagtctaattttaaactagtcacatactgcctgtatttactcaactccttcaagggacatataacctacaaaaacaaaaaccaacaatataaatacaaggttgtaacaatgataacactttacagaggagagggtgaaaagaatattcattttaataaaaatttgggataaggtctaataacaacatattttggtgacaattttgaagtcagcatctttatacaattgctgtctcaccaagaaatttctatccaaacattgttttattagtatggttcatatcataatcaggaatttactattcccaatcaaattgttattaaaacacgtatataataatgatgcttaactccccaaagaatttattctatcaatctgtattttgctagtttctcattttatctccagttttctcaaagtgtatgagaaatattctttgacaggtagacggtgatattaccacttttggagccagaggaaaagcactacaatacaactgggtgaaaataaataaataaataaataaataaataaataaataaataagtgtgtgtgtatctttgcatactcaaatcattggtaatatctgttgctattaaaatggaaataaaggtcaagtaggaatgagttttatttagacaaaacagctacctgatttcccttggccccagtactgagttattcattgagtcttttattgggagtcctctactgctcaattgaaagttgacacaggctcccagtgaggtaaagggaagcacctaggtcttggctggttaacaggaggtatgcttcaatgcactttattattgctagtgatgtagccacccttctttaatggcctcagaatatcttttcactgatagtttgtttttaaatgtgcatcatgtagacttttataaacctggtttcctaaatttggcagtaaggatcagtcaggttaaaatcctaagaaggttaaaaaagccacaaacaagtagattcaaaagcattacaaatgtaaaaataaacgaagccacacttttaaacatcaatttatttaaatgattaggctgttcactgaaaataaaacttgcaagcagaatgggaagtgagagaatacagacaatgggctgatttgggtaaacctaactgctttctctctctctcctctcccaggcctgtctttaggctggaagtgtcctgtggaatccctatctgtgaaccctatattcagtcttcctgtagcctcaacctcagtccaattcctgaacacagaggttgggattgactgttgtgaaggagaggaggagagtgcatgtcaagtttcagtagctggatggacgaaggcacggaagtaggaatcagcagggtatgtgtgggtaggcagaaaagaccccaacctgtcagtgaagactcttgggttggagataaggttggatggggcggctgaggcatatcatggggctttctgtcattaaaatgaggtttaagaatttaaacacttcaactcatttaacttggtatgtaaaactgaagttaacacaaagcaaaatcatagcaaaatgtttcccatttaacagcaaactgaaaagggtaaagaaaatcacttaagggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccatgcgcgagccgaagcagggcgaggcattgcctcagctgggaagcgcaaggggtcagggagttcactttccaagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaacctcgctgattgctagcacagcagtctgagatcaaactgcaaggcggcaaggaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgatgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccaatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcctatccagccaaactaagcttcataagtgaaggagaaataaaatactttatagacaagcaaatgctgagagattttgtcaccaccaggcctgccctaaaagagctcctgaaggaagcactaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaatgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacacattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaactacatgattatctcaatagatgcagaaaaagcctttgacaaaattcaacaacccttcatgctaaaaactctcaataaataaggtattgatgggacgtatttcaaaataataagagctatctatgacaaacccacagccaatatcatactgaatgggaaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcatctcagcccaaaatctccttaagctgataagcaacttcagcaaagtctcaggatacaaaatcaatgtacaaaaatcacaagcattctcatacaccaacaacagacaaacagagagccaaatcatgagtgaactcccattcacaattgcttcaaagagaataaaatacctaggaatccaacttacaagggatgtgaaggacctcttcaaggagaactataaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagccctcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttctttacaccttatacaaaaatcaattcaagatggattcaagatttaaacgttagacctaaaaccataaaaaccctagaagaaaacctaggcattaccatccaggacaaaggcgtgggcaaggacttcatgtccaaaacaccaaaagcaatggcaacaaaagccaaaattgacaaatgggatctaattaaactaaagagcttctgcacagcaaaagaaactaccagcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgctgccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacttggacacaggaaggggaatatcacactctggggactgtggtggggtcgggggaggggggagggatagcattgggagatatacctaatgctagatgacgagttagtgggtgcagcgcaccagcatggcacatgtatacatatgtaactaacctgcacaatgtgcacatgtaccctaaaacttagagtataattaaaaaaaaaaaaaaaaaaaagaaaatcacttaagcactattaaaacttcgtttaccttctcacttagaactgtagtatagaatacattatcgcttcctgggataacaggcagcttgaccccaagacacagatccaaaagatgatatgctctgacctctggaatggggttttcctgcgagctctgtcagatgcaattggaagtttgtattttcttctgtatattggtgcaaaagtaattgaaagtaatggcaaaaccgcaattacttttgcaccaacctaatagaaattattcatttagtttagaccaaacgtattattacttcctattaaataggctaatacctccaaataaaccaaagaaccatgcattcggggttgaaggaacccgccaggccggctgacaacttggatgtcctcgtttttctgggttaccagttctacctctcgacccctgccagtggtggccagtggccgccaaagccaccggctgcccagagctaaggggctgaaagctgagcagtcaagaacccgcctcgttccctcccactcgcggagatctccctactcggtctgtccgccttccggagaccctcatttggggccacgagtaggaagacggaccggcctccactcacggtgcggcactgcttcttgcctgcattcaggctgctggcggccgccttagtggcggcggcttcggcagccttatagcagttgccgaggtacagctccagagccagccttcagtccccagggggccagacgctggggtagcaggcggtcctcgtttctcctcattcacacccttcacgctttaggtcctgatcaggtgtgggctgccaagatcgtggtggccagagtagaacgtcctctaggccacgcccctcacaatgctgccttctaggctggagagctgacgtcctcaaggggcgtcaccctcggaggtggggtgggcagcgggtgagtggggagtggtgaccgctaagcctcaccagacgcacaggcacacgagacttcagccccttagagtcgaaatttaatatctctttgaaaccaatacccctcatttaaactaaaccaaaatatatcaagctttgtccatggtagctgtgatcgtactgatttctgttcaacaaacttcgatgagtaattgtgtagtttttattagggccataggactgacttttacatctatctcctttatagacactgtgaccctccttcccctaggcataccacccccagtcccatgtagaacacttggtttcttcaagggctcaatacatttctccttgtctttctcttctctgtcttgggctcattatctctctcgccctcctcttcctctttctctctttcttctacttatttgtttctaccttctcattcagtcagccaacatttattgagtgcccactctatgccagactctgctggttcctgacagtgagtacactgataaaacagtgagtaaaacatagtgtctgctgccaagaagctcagtagaatgaaaatatatgaaggactgagactgtacctagttcatgctctgtctccacgttatctatcatctatctatctatctatctatctatctatctatctatctatctatctatgtatctatctatctatcatctatctatctatgacacattatagttaaacttctgaaaactaatgacaaagacaaaaattcttgaaagcagtcagagataaaagaaacattatttacaggagaacaccaatttgaatgtgaatttgaaacgatggaggcccgaaggaagaggtgcagcattttttaagtgctttagcattttcttttaagaaacaaattgtcaactgtgaattctatacctaatgaaaatatctttcatcaatgaagaagaaatagagacattctgagatgaaggaaaactaaaaatgtgttgctaacaaacctatcttaaggaatggctaaaagaagttatctacgcagaaaggaaatgataacagaagtaggcttagaacttcagaagggaaaaaaaacccataagaatggataaaaatagggataaatataatagactattctatttttcttgagtttcttaaatcatatttgatggttgaagcaaaaagtataagagcatctgatgtggtggtgaatacatgtaaaggaaatatttaagacaattatattttatttttccctttcaaattgtattttaggtttgggggcatatgtgtaggtttgttacatgtgcaaattgtgcattgatggggtttggtgtgcaaataattttgttacccaggtagagagcatagtacatgataggtagttttttgaccctaaccttcctctcattctccaccctcaagtaggcctcagtatctattttttccctcttctaaaacaattacattttagaagtgggaagtgcaaagggacataaatggaaataaggcttctacactttattcaaagtggtaaaatattaataccagtaggttgtggtaaactatatatatattttgtaattcctagagcaactattaagaaaactatacgaagtgatatattcaaaacattataaataaatcaagataaacttctaacaatgttcaagtagcccacaggaaggcaagaaaagggaaatagaggaatgagaaacaggggaaataacagaaaacaaataaaatggcagatttaagctctaacataccagtaattacttctctaagcgtaaatggtctaaactcagtaatgaaaacagattggcagaaccaattaaaaaatacatgatccaactacatgctatctacaaatactatacactgcaaatacaatgatacatgtaagtaggctgaaaataaaaggatgggaaaagatactcaaagcacatttgcatttgcaaaagtaggagtggccataataatatcagataaagtagactttaattgctagagacaaagagaaacattacttaatgaaacaaagatcggctgggtgcggtggctcatgcctgtaatcccagcactttgggaggctgaggcgggcgaatcacaaggtcaggagatcgatatcatcctggctaacatggtgaaactccgtctctactaaaaaatacaaaaaattagccgggcctggtggtgggcacctgtagtcccagctactcaggaggctgaggcaggagaatggcgtgaacctgggaggcggagcttgcagtgagccgagatcgcgccactgcactccagcctgggtgacccagcaagactccgtctcaaaaaaaaaaaaaaaaaagaaagaaagaaagaaagaaagaaagatcaaaccaccaatccaccaggaaatcaatggacatgcaccaaataatagagactcaaaatacatgaagcaaaaaaacaatagagataacaaaagaaatagacaaagtcacaattataatgtgggacttcctaaatgcctatcaacaggagactggacaaataaagtttatgcttcgctcatgcccatatagcagtttaagttgaaagacttggagctacgtatattaacaacatgtatttcaaatcataatcttgagcaaaacctaccaagagttgatataactgtggaatgacctaacttatttgaatcatgttaatggataattatttatgtagtagtagcataaaatcctgcatgaaaaagaggaaaataaatacagtatagtagtatctctagggagaaagggaggcaaatgaaattatgaagggatatgaaggacgctttcacttcatctttcatattgtatttcttaaaaccaagtctggctcttcttttatctcttcctgtttcctgttcttttctttcccttctcattacttctagaacaattcaagaggtgggttggagcaagataggtgtccaaatagaggtgtagctctagatgttggtgcttaactggggtaaggaggggaaccacagatgaaggcagcctgaagtggaggcagagcctgaagaaagtgaaaaagttgttccttgtgggggttggtttggtgtaaagaatcagaagccaggaggagaaaggaagccatccatgtttaaggggagctaagtgagggatgtcagagcccaagcagatcaatgaaggtgtttacatcaaagatggtctggcatgggattcagagcatgagtagagtgagggggctatcaatgtatgggacagcataggatgtcagagtctgtgctagttacccagggctgccatgacaaagtaccgcaaactgggtagcttaaaacaacagaaatgtactgtctcactgtcttggaggctagatgtcttaaacaagagtgggcagaaccttgctttttctctgaaacctgtaggggagtccttctttgcctcttcgtagtttctggtggtttgccagcaatctttggtattccttggcttgcaattgcataaccccaatctctgccttcattgtcagatggaattcttctggtgtgtcttggtcttctcctggctgccggcttaaaaagacacaagttatattgaatcagggacccatcttggtccagtatgacctcattttaacttaactaattacatttgcaatgaccttatttttaaatgagatgacattctgagatactgggggtgcgaacttcaacatttccttttctggagggcacagctcaacacatcacaatctgttctttgccccgcctccccaaattaatgttcttcccacctgcaaaatacattcaccccattttaatactcacaaaagtcttaacgcattccagcatcaacgttatgttcaaaatctcatctaattcagggatgggtaaagtttgggccatggtccatcctgaggtaaaattcccctccagctgtaaatctgtaaaacccagaaaacaagttatctgctttcaaaatacaatggtgggacaggcataggataaacatttccattccaaaatggagactgggctaggcatggtggctcatgcctgtaaacccagcactttgggaggctgaggcaggtggatcaagtggaactcctgaggtctggtgttcgagaccagcctggccaacatggtgaaaccccgtcactactaaaaatacaaaaattaggcacgcatggtggcgggcgcttgtagtcccagctactcaggaggctgagacaggagaatcacttgaacctgggaggcagaggttgcagtgagctaagatcacgtcactgcactccatcctgggcaacagagtgagactcgatctcggaaaaaaaaaaagagactggacggtaaaaaggtctaaggcagtttgcaacacagcaggtaaaattccattaggttttaaggcttcagaataattttctgtggctttgtccaatggactcacctcttcatccttaggtggctgccccaatgtctgtaaagaagaggctaccttgcccctggttcctcatccttatatggcaatcctgtcccctgaaccctgggtagaggtcccgcccactcaggccttggcagtcacctggttctctggaacccaggagatgtctctgccctctggaaatgaggaggcaaactgacgctctcatcccagagcagtggtcccaccctttgaagaaagagggggatgctaccctatggaactcaggggcccaccttaccatctataaccaaagattccgcttatcccattggtcctggctggtgaccctgacccctcaaacctgggcaggagccccatcttctgcaaacatagaagatagccttatcctctggaaatgagaaggcagcctggtccacagggtcctggttggtggccctgtcccctcattcctgagtggtggtgactcaggcccctgggtctgaggcagtggctccacactctggaaccctggaggtggctctgcccctcagaattggatagcagccccgccctctcagccctgggcagtggccctgctgggcaggaaccctggaggtagctccacttcctggatcctgggcagtggacctgccatctgtaaacccagagatggctctgtaccttcagccttggaaggcagccctgccgtctcagccctgggcagtagccccgcactcaggaaccttgcaggtggctccaccccctcagccttggatggcagccccaccctctggagtcttaaaggtggctctgccctttcagcccttggcagtggcctaattctcaggatccttggaggtggttctgcccatcagccctgggaaatagctccgctccatcagtcttggatggaaacccggctctctcagctatgggcagcagcccgaccagctggaatcctggggatgacctcactccctcagccttggatggcagccccaccccttcagcccagggcaatagccctgcccccaagaattctggaggtggttctgccccctcaggcataggaagtggctctgtcccctggagccttggaggtggctctgccctctctgccttggatggaaacccgccctctcaggcctggcagtggcctcaccccctcagccctggatggcagcaccaccgtctcagccctgggcagtggcctcgcctattggaatcatagaggtggctcctacccctcaggactgtgccgcggctctatcctctggtactctggtagtgacctcaccccctcaggcttggatggcagccccatcctctcagttttcagcaggggccatggactctagaatcctggtggtgactccactccctcagctttggatggcagcaccaatccctcagccctgggcagtgggcccaccgtctggaaccctgatgacaatatcagttccgcagccatgggtggcagccccaccctctcagaactaggcagtggtcccgccatctggaaccatggtgatgaccccaccccctcagccgtgggtggcaacacagccccctcagccctgggaagtggtcccaccttctggaatcttggtgatgacccaaccccctcagccttgggtgggagcaccgccctctcagccctgggcagtgtcccacagtctggaaccctggtgatgaccccaccccctcagccttgggtggcagcaccacccccacagccttgggaagtggtcccaccatctggaaacctggtgatgaccacaccccctcagccttgggtggcagcaccacccccacagcctgggaagtggtcccaccatctggaaacgtggtgatgaccacacccactcagccttgggtggcagcagtgccccctcagcagtgggcagtggtcccgctatctggaaccctgttgatgaccccactccctcagccttgggtggcagaaccgccccctcagccctggccagtgggaccaccctctggaatcctgttgatgaccccaccccctcagccttgggtggcagcacagccccctcagccctggacagtggtcccaccatctggaatcctggtgataaacccacctcctcagccatggggggcaaaaccgccccctcagccctggccaatgttcccactatctggaacccttttgatgaccctatcccctcagccttgggtggcagcaccaccccctcagccctgggcagtggtcccaccctctggaaccctggtgatgaccacaccccctcagccttgggtgacagcaccacccctttagccctaggcagtggacccgtgctctggaaccctactggtgacctcccctcagccttgggtggcagttctgcctttgcagccttgggcagtggccctgtgctctagaactctagtgatgacctcaccccctcaaccttggatggcaacactgccctgggcagtgggcctaccatctggaaccctgctggtgacctcaccccttcagccttggatggcagcactgccctttcagccctgggcagtgggcccaccatctggagccctggtggtgatctcattgcagcagctgtgggtggccacatcaccctctcagccttgggcagtggccctgtgctctaaaatcctggtgatgaccttgccccctcagccttggatggcagccctgcactctcagccctggttagtgcctccacccttggcaaccctggaggtgaccctattcccttacccttggatggcagtcccaccctctcagccctgccagcaaacttactctctagaaccctactggtgattctctctttcagccttggatggcaacaccccccacccccgcttctcagccctgggcagcagcaccacctctggaatcttggtagtgtctccacccactggaaccctgccattatcccgacaccctcaggactaggcagtggtcctgggatccctggtggtagacctgtcccctttggccctggggagaggtcccaccccctcaggcctgggcagtggccctgttctctagaatatagcaggtccaaatggctcagttatctgcatgtatcgctttcccagtcattcttccttcattttgtccttttcagtttcttttagtccaggctggttgtgtttctgaggtataaaattctaaaaaaattttgttggcttcccctgcaattcatggaggtccaagccaacagaaaagagggtactttatagatctttactgtataactgcatctcaattcctggcttctgctagatggttgattggatccataagtcacaattatggatatctgtaagtcataatatctttatcaatggttgttctgccatacttttagtcttctctccagaacacagcttgtttctttctttctttatttagagatggtgtcttgctctgtcacccaggctggagtgtggtggcattatcatggcttcctgcagccttgacctccctggacttagataatcctcctacctcagcctcctgagtagctgggactacaggcacacaccaccatacctggctagtttttgtattttcttgtagagatagggttttgccatgttactcaggctggtcttaaactcctgcactcaagtgatctgcccactttggcctcccaaagtactaggattacaggtgtgagccaccatgcccagccagaacacaggttatttacttttttgcaatatggttaggttgagaatattacaaatcttcaagttctggttcctttatgcttaacaatttgctccttaatttatctatttcctttctcatcttactctaagaatcaaggcagaaacaggatgcatgttacacactttccttggaaatttccttctttaaataaacaagctcatctcttacaagttctacttccttcccaacagtagaagacaattcagccgaatcctttgacattttataatgaagatcacctttcttccaatgcccaataccaggaagctcaccaaaagtacctttaacatttacatttcaagcaatgttcactttaaggcaatctaggctgcttctgtaatgagcctcaaaatgtttccagcctctgcccattacccaattacaaagctagtttcataattgtaggtatttgttacagcaaggatcccatttcccaataccaaaatctctattagttttctagggctgccaaaataaactaccacaaactgggtgcttaaaacaatagaaatttattgtctcacagttctggagggtagaaatctaaaatcaaggtgttgatagtgtggagtcctaactagggaaaaaatagttgggatggtgggactgagagaaaaaaaaagaaaagttatgtctgccttttttttctttttgtttcttttttcttttttttttttttgagatggagtcttgttctcttgtccaggctggcatgatctcgactcactgcaacctctgccttccgggttcaagcaattctcctgtctcaacctcccaagtagctgtgactacaggtgcatgtcaccacgcccagctgatttttgtattttagtagagatgggatttcaccatattgatcaggctggtctcgaactcctcacctcaggttatccacttgcctcggcctcccaaagtactgggattacagacatgagccaccgcacccaggctatgtccgcctttcttcatagtccaggacacacagcccgcttgcacaaataactcacaatcttcctgtgtccagctattaccagacccccaggtaacagaaaaatgcaagttagtttccagtactgataaccttggcattatcagtactgcacaaagccctcatcaggacacagcacaagtatcatactataaaatccccagcaagcctttgtctatggcagtcagctcctctcttgctaacttgcccattgcagtcttgcattgtgtttttgtactttagtaagtcatcttttctttacttacaactatcttggttaattcttatctgcatgccaccggccccagatagtcgctgctcacctgcaacattttggtggcctgtacaggaactcctctctctgtgcaggagctttctctctccttacagggaaccctctcccctctcaatttttctttcccaactcgggacccttggtggacagcatctaagcgtggagacaactgtaggtctctggctggggctacactccagcgggactgaaaggtgtctgtgtgggaagcatctgagcgccatgctcatttgggtgagtgagggacctgagttagttttctctgttcagtgtcgcagcagccagcttctagtatccctctggcaattgatggtaactggctagggccactctccagtgttgcctgaaggccagagagtgaacagggctggctgccttgcctggaaggaagactgtctctcttaccttttttagtctaaagtccctaattcctgtgtgtgacttagctgacagcagaagttcattcagagtgaattcacacatgttttgggtgactcagaccatgtttcttactctgaattctctggtggagtcagccagccatcctgttctgaacgttgctcaaccaggtgatctccgcctcagagaggcgagtctcccttacctgcccctctcctgggccagcaccaaatggagttcttcctttaccctttttcctcgtacctgggctgctcacccagcgtaagtgagtacctggactggccatccagtgtaagacccccgagtggctgagaggtcttttgtaatagctgggacgcccctttagaaagtgcacctgagtccctcagcagacatgagtgggaccttttttttatcttggcgggatgccccaagagaaagcgtggttcaattagccccaaatggctcattttccagtcccactatgggacaaactccgtcaattccttcagactcacctctaggctgcattctaaaacattgggataaatttcaccctcaaactctcaaaaagaaacatctaattttttcgtgtgatacagcatggcccctatgcaagaaattctcaaattagcctcctcagtattttataaccaagaacagcagaaggacaggtctaaggagagagaaaaatgcagggacaaaaaggctgctttacaagccccagccccctccaggttgtcctaaggacactcctccagataactgccatcagtgcagaaggccaggccactaaaaggcaaagtgccccaatgggataaatgggaaaacccctgcatggcttgtcccctctgccacaaactcggccagtagaaacaggactgccctgagaaccaaagcctcccctgccccccaggacagtatcccaacccctgatggctttaagctgaaggggctctctgctccagctgaaaatagctcaacttaactggtgacttgcagaggtgggaggaatttgtcctacactgtgtaaatctggggtgctaaggctctccttgatgggaaataaacaagggtgggaggggtgctggcctcacaccatacagtggctggaaggctcacaagtccttctgtaaagattaacctttctctttccattcctttcattttttctctttttctgttcaatccaaatgtccagcctcaaaaggaaaaggcagtttctaacatcctaacccttgattttgttattctcttaaaaaccccagctgattacatattatggcccatttttgtgcacattttaaattgatgggcaaattacaagaaaaattcagagctcaaatggttaacctgtactaagagttaagtcaagtcttctaaagctatctgtcttcctctctttttttctgcctgctttaaatctgccattactaagctgctggtgctaagactcattatttatggtctaactggaatgtaaacactggaaactcatttaaagttaaaagaaaaagggtaaaacaagttttattaaaccaaacaacctagaatttttaacctcccttaaagttgatagaaataagtccagcacctctcttacaccttattcttaaagctgactctttattctattctactgcaagctctcagtagtgatccaactgcctctcttgagcagcttcgccctcttgatattaatacttttataaggaaggtagcatatgattgctatttggagggggatctccaagactactgcccagatgaaatttctttatatttgtcctggtaatgttatttacccacacaccataacatcaatatcctaaggtagtaggtattttttttaacattttgttttcttatactctttacagcccttcttctttcctgtctccctgagtttcccacatattgttattttccttaaatgtggctctgtttttattctgtcatggctaactattgtctcaatggcttcacccaggcacccactctagccagtaatatatcaagttgccaacataacacagtactgactactgaatatgcccacgcaggcaggcacttgagaatggtattacactcctagcagtcccactatctatagataacacacaagcccaatgatctggatttgaccacactatttacatgcacatcaaaaacacaggtttaggagggggacctaggccaaccaatccctcgtgacaatcatccactgcaactgaacggattgggaaggcaccagagaatggcctgtaaggctcgcctctgcgttaaaaactccaagtagtctggccctttcctaggggctttaacacaagcccagtgaaattccaccctcaactatagtcaaacacaccaggaatgggagccatacgatgcctgtgatgagttcactgtgtgcccccacagattttctctatggtggggaaaagacaaagttaaggccagcaacctttatagtgattcctttatgcctataaagagttcagctaacaggatggaatatataggaataggggtcaaaactggacaacttcttaacctcaccaacatatctacatcttttcatcgattttcccttatcccatttatatttacaaatcttatctctcaggctccacatccacataacacaacaggtcaaacatttccccccttatgcatgaatgactactttttgggtcattgtccatccacgtttgatccctggggaccatgggatccctggatttatgcaaattatactggaatccaaactaaccacacctgtgcctggttacgagctccctcctcaggagtttaacagaaactgggttcttcttttcatgtggacccaacctgtttctagccttgcttattcagtggaaaggcacgtgcactatagttgcagccatacctggattgcatataaatatatatgtaatttatataaatatatttgtgtgtatgtgtatatatatatacatatatatataactcctcagacttcataacctctagccaagttccaaatttaggatccttccgaaatcaggccctacaaaggccattcgaaaaaaacagaaacgtgacttaatcaacctcccatcatctggcatcctcaccactgagaatccgtggcaggcaggaatggtctaggacattctgtagcctgtgcaatcttttggtttgcaggtatacccatgcttaagtgtagcattcataatctcaccatcctagtccgacaatcttgagaagctacagtaacagccattgagggccaacaacgggccctagattcattggcaggggttgtcttgcaggatcaaggtgctttggatgtgcttaccactgaggcaggaggcacttgcacactgttaaatgaaacttgttgctttacatcaatacctcaggtaaagtagaagaaagtttggaaaagataaaagaaaacatcaggacaacagagggccttcaaaaaggagttcctcaagattcctcttttgcacaactgttttagagatcctacggttgggttgggccacgggttaccccacttcccctgcctataataatgctcatattagtttgtttatttacagcatgtatcgttaatgttatatatctcattttgtgtcttctagaatataaaaatttcaaaccaaaatgttactgcatcaaggatgtcagccactaagagaactctacaacactcctttggacacagcaggacaaaattttaggctgcaaatgctgttcagccgtggtcccacagccaccctgcccaatttaattcccaactcagggactcaggtcctcataacctcctgacagactaacaatcctaggtagggccaactctatgcccctggtcagcaataagcagttggaagatgagaccttcacccacacaccaaagatttgtcattgttgctctgtcacagggggaatgtggaatcctgtttagggaaaaaaagtcaggatggcagcaccaagaggaagcaaaaagaaaaagcagataagctatatgtctgcctttcttcatactccaagagacacggccctcctgagcaaataactcacaatcttcctgtgtccagctatcaccagaccctcagctaatagaaaagtgcagattggctcactgcaaccttggggttttcagtactgcacaaagccctcttcagcacacagcacaagcaccatgctataaaatccccagcaagccttcatctcctggtagtcagctcctctcttgctaacttgcccattcattgcactcttgctatgtgtcttcatcctttaataaatctgcttttctttacctacaaccgtctaggtaaattcttcttacctgcgtaccactggccccaaatagtcactgctcaccatggcaagtagggccatgcttcttctgaaacctatgagggagtccttccttgcccgtttctagcttctgggggtttgtcagcaatccttggtattctttggctttcaactgcgtaacttcaatctctgccttagtcattgtgtggaattatttttacatggccctgtgtgtctctgttttcatgtggccatcttcttataaggacaccatttgaaactgtgatatcttctgaggtacttggggttaggatttcaacatatgtttttagaagacccagaacaaagcctaaacaaagtgaggagggtctccttgtacgtgggcagcccaggatgagaaatcagagctgcagcggggttgggagagggcatccacacatgtgggtggcgtggtgcaggtgtgttatatcctgggcaatgtgagcaaggcatctatgtaggggaaagcctgggtaggggggtctgagcccaagcaggatgaggagagcatctgtgaaaagtgctctgggtttttgagcctgaacagggtgagcaaggttgtggtctacatggggatgggaagtggggagcccctatggcttatcagagccttagtgggggtgaggaaggcatccacgcaggaaggacaacctagcttggggtgctggagtccacctaatgggaggagggtgactatgtgtgcggatagcctggtatgggttattagagctatcataggacgttgttgaaacaactggtagaacttaagtgaaatctgaaaactctgatggatgaattgtggttatgtaggaaaatgtcctagcgcccgttaaatactaaagtatttgaggactatgggacatcaaattggcaactagaaaaaaaactctttgaattgtacctgtaacttttctgtaagttttaaaatacaaaattattaaaaactctgaagcaaatatggcaaaatggtataattccagaggcctgggttgtatgtccacaggtgcttattatgctatcacttccagttttctatctgattgcaacattacaaaataaaaatacttcaaaattaaaggttacgcatgtttattattaaaaaaaaaaggtaaatcactcatgagtttattgcccaaagacactattaacgctggatatattttctttatgtcgaaaaaagataattctcaaggtaaacagattttgatggtataagattttgaaggggggataattttcttaaagctaaaattagatagatcattttccttttttcacttttagaggaaatgttaaaaatgctcacgttagtcttctcgccgcaggcgcctgttcacgtgtaaggcattgctgaaatcactagagggcgcgctcctgtcaaagcccatacaaagttctgagaatgctgtaacatgttttgaaaccttaaaataaattcagctgggtgcggcggctcacgcctgtactcaatcccagcattttgggaggctgaggcaggaggatcgcttgagcccaggagttcgagatcagccaaggcaacatagcgagaccctgtctctataaaaaataaaagaaatgagccaggcttggtggtacatgcctgtggtcccagctgagaggctgcagtgaactgttatcatgccactgcactccagtctaggtgacagagcgagaccttgtctcaaaaaaaacttcaaaaaagctttcatccatcttttaaaatatcagcattttatccaggtctttttttttttaaatctatcttacatcggcttacttttaaaatcagaagatgtggactctattgtctacatcatgactgttaaaatattggatttttcatttatacctaattttaaatttttgccctatgtagtagcatgaatcctcttgatgttccgtaggttcttcctacaattttctcacacttctgcgaggcagaattgtcacaattaccctgccagtggtcctgtcctagatatatcaccctttctttggagttgtgagacctgtttttatttttataaattagaaataatctgcttctttctaagtttgatggttttcttttcttcttcttcttctttttttgacagagtctccctcagtcacccaggctagagtgtagtggcatggtctcggctcactgcctcctcctcccgagttcaagcgattctcccgcctcagcctcctgagtagctggcattacaggcacccaccaccacgcccagctaatttttgtatttttagtagacacagggtttcaccatgttggccaggctggtcttgaactcctgacctcagtgatccgcccacctcgaccttccaaattgctgggattgtaggcataagccactgtgcccagccaagtttgatggttttctaaaaaaaaaaaaaaaaaggtaatggatagtttccttgcttgaaagcaaaatcagtcctcatattggggtgtagcggggggagtgtcaggagctgggtttgtgtgagaaggtgtttggtggtggtagtacttgttggggaactttggccatgaagcaagcccattgccagacccaagattgtgccactgccctgttgttatgatgactacatcgttgggatacagagagtgtcagaggtgaaagacacctgaaagaaaaatgtcatgttctatctgtgtttggtgaaatcctagggttccacaaatgtttcatctgaatttccctaagaagttcttgagcccaaacttgtactacaggaaaatgtgtccattcaaatgccaggctagtttatttttttagtaggcctcaaaatacttttggtgttttggtactcagttttaaacttcttttaaattttatcgattaataataataatagctgatacctattgagtgctaactatgtggcaagcaccttgcatgctccatctgatttaatagtgtggttcacaacgttattttcccattttatagatgagggaactgaggcccagaaatcgtaagtgatttgatcacttaatttagacctattggactccaagtcttgtttgcttagccattaaacactttggccttctcatatagatagttcacaacactgtgcttcccccaacccctcaattcggacctgtgggcttctttgtatgtgaagttgcataatcaagtaagctggtcaccctcaaagctaggcaagcctcagagactttgcacttgtcacaacagagaacacagtgcaaagacctgatggaagcatgtctggaggagcagaaaagtaggccaatgtcactgaagtagagtgagtgagggggagagtaatagaagaatggactggattaggaacagaggaccagcttttatagggacttacaggtctttgtaaggcttttactcggaatgaaatgtggagccattgcagggttttgaacagatgagagacatgagctgacttagaggtttaacaggatcattccagctgctgtgttgaaactagacagtgggtggtcaagggtagaaacaaggaaacaagttgggaggtatattattttcccttaggaaaccctaacaaagtaccacaaactaggtggcttaaaataacagaagctgattgtctcaaaaatctggaagctagaaatctgaaaccaaggtgtcattggggccatggtttctctgcgactgcgtggaatccctctttgcctcttcctagcttctgtcagtggccattgatccttgccattccttggctttcggctgcagcactccaatctctgcttctgtcattgtatggctttttccatgtgtgtctctgccttcacatggccatctcccttctgtgtctccctcctcttcttataaggacaccagtcatattggattaagggcccaccctactccagtatggcctcatcttaacttatctaattacatctgcaatgacactatttccaaataagattacattctaaggtactggaggttagcatcacgacatatatttttggcggggacagactgtaacccatagcaggaagctatttcagtaatctgggcaagagataaggggagcttgaaccaggatggcagcaatagtggtagtgagaagtgatctggtaatgaatatatgtggaaggtagacccaaaagcctttgctgatgaaatgggagttggcccaagagaaagagaagcaaagatgactccaaggtgtttcagcttgaggaactgaaaggatgaagttagcaacaagtgtgatggtaaatgcagaaagacagcagatttaggagaaaatcatggtttggttttggacaaattaaatttgagatgcctgttagtcattcaagaggcaatgttcagtaggaagttagttatatgagcctggaattcaagaaggagttcagagctagagactcaaatttgggagtggtttctaaggagaatgagagcccacttgtgattttaggcataaagcttaacacgaagcttactccagccaggatcagttactgggatgcagatgtagacaagacgaaaagttggacttaacctttgttccagtttttctaggtaggtgtgatgatgggagagggaattggggagctgaggatggatgccaaggagtgatgataataacggaccgtagaatctaagtgaaataaacatgtaagtgaagatatgagggggtgatagagggtaaaaagatgattaacagtgggagggttgttagagtggagatattagagggaattaggaagagagagaaaagagtggggtgattaaaattgagatttttttcagcagaacattgactaaaaagaaattttttaaaaataaaattgagatgttgaaggtcctgcagtagtttatgacgagatctaggaaataagcctggatgtgggtgaccaaggatggaaagagagaacaagatctttggagtggaggaggtcaagcagctgagagaccagagtgctatatggattattcacaatgtagacaatgaatgtaggtctgcacagacacatgcatgtatgtatgcagactccacatagatattgaaatcaccaagaaagatgacaggggcagttgtgaaaagacagtgaaccacaagctcaaatcatcaatgaataagggagagtgaacaggaagaggggagatgataacaacaaggaggtgtagcaggtaacacactctgaaacttagtcttacagcaaagtgattgaaagaagctggggcaggcagtttggggaaggtctacacacaggaagtggtaagggggagcaaagaggacacctgttccacctctgggtccagtggtacataaagtatgagaaaaaaaatagtcaccacttgagagcgctgtacaggaagcaatgtcttcagaggggagccgagtttttgataaacccaaaagttcaaggaaaattttggagaagctgagaatgtagggaattttgcagagagaaaggtcaaagggtttgggagggttgggaaggggtggtcgattgagtgagatgaggaggtgcaggaattcatttccatgtgagtgatcatggatgatctagatggtttgaacttttgtgatgactgaagtaaataggcatttagagcacgatgaaacctgatgatctcttggctggggaacagatggttagttttaaatgtagcctctccttgggactggtgtgtcctgtagtgcagtgtggtctataatgggaatgatggggtgaggtggagttgtggtctcactctcactaggagcaggtggaacactgggctccctttttttttttttttttactttttgtggagaatggggtctcgctatattgcccaggcaggtctcaaactcctggactcaagctatcttcccacctctgcctctctaagagctgggattataggtgtgagccaccgcgcctggccctttgatgttcttaagagaggcgtcaagtccagaggaggcttgatcttaccaggagagattgtaactctcagggtctctcttttaatcctattgggtcactgtaatacttctcttatttcttttattttcatagtctgctcattactttaacatagtacaatgatgtttgtttttgtaaaactgatacatgatcactatgaaatattcaagtaatggagaaaactataatgaaacttaaaaaatcctccccaaataccctcattaacacttggttaacatcatctcagacttctctatggatttttacacttgtaactattttacatggtcttgtgtttcctttaaataatatgagttattgttgtaaacagtttgagtactatagatttattctaatcctctcactttacaaatgaggacattgagttctagagaaaggaaagtacctgtccaaagacactcatcccgtcagttaggcccaggtctcttttttgtttttttttttctttttcttgagttggagtctcgctctgtcgcccaggctggagtgcagtggcataatctttggctcactgcaacctccacctcccgggttcaagcaattctcctgcctcagccttttgagtagctgggattacaggcacccggcaccacacccggcttatttttgtatttttggtagagacggggtttcaccatgttggccaggctggccttttggccaggctggtctcaaactcctgatctcgtgatctgcctgctcaggctcccaaagtgctgggattacaggcgagagccatgctcccagccaggcccaggtctctttactttccagttcagtgggtctctttaagccgtgctcctctcttcttctcttaccttctacatagcatggtccctgatatttcaactcatagatttctgcattcagagatctcactttgcctttggttttgaacacttattcatctagtcattcaacaaacctttattggacatctgctatatgccaggcaaaaatgttaggcactagaggtgtggtgatgagcaaaacagacatgatctctcacctcatgaagcttacattctacagaatgcacagaaagtttgtgctttacttcctaactttatccattcaggccaaggcgcatataactatgcacttgtttataaccccaagtcattcgatggtgatgggaaaagaaaagaaaaatcgttagacttaaagtcatatcactagcacatgggagtaccaaatgaatacttgatagtcatagatactaacaaaatccatgaggtctagaatacttttctgtaactatagtttcaagcattaatttaaaagtttaatttaaaaatgccatagtgttacgtataacaaaaatgcccaaaacacaacatttaaaattttaaaatatatatgatctataaggatgcaaaagtccttctctctaattgtaccttccagaggtagcacttctaaaccctctgatgtgtgtcctcatcaacttttctctatgcttacatagattttattttttaataataacaggattgcgtaattgttgccaaattcaaacaatgcagacagacttacactgtattaaaagtgaaaatttctcatatactcacccccaatctcagtcctcatgggtgactattaacatattgatgcatatttgatgtgaatattttcaaatctttttctatgtatttacatagaaacacatgcatgaacacacacacatacacacacacacacacacacacaagcaaacagggctgtttacattttttgttttaaggcagcagtagtcagaaatttaaagttcagaagtcgagggcacattcctgtgtttttcattttcgacaagtagaacaatgcagccatatgccggtccctctctggagttagtacccaatgcttggaatgtgagcagatgctgaaggctattaatgaagtccttgaagggaggcccattcatgtatgttgtagacacaaggccaaagttgaatgtggtggccaactgagcagctggtaagggactaggaaagcgaggaatgcaccaatgctggttgcgagttgatggaccatgggaaccacatcatctggaggagtgtcctgccattgctgtcatttaggaaatggaagcaacacttggagtcctgaaggcttttaacctcagttgttacattagtgtgttgcaaatgtgatagagaaaaaaaatctgggaaaaatgatctgatatggtctaaatgaaactagtttttatcatgcctaaaattggaaaactccaagactttctttttttctttttgatttcttggatacaaagaacaagacacagtaatgtgtgtttgattaatgccaactccctgaactccttaatgtcaactagctactcttcattaccaaacaccacatgtgctcttctttcagtttaggcataccagcgcagctgcagaagacacagtggtgatctctatcacaccaacaatcagatatttgtcataatagcctcctaatcatatcgcatatgaagcctcaatgaagtctttataaccagacatgaaataattaaccttttctaatttaaaagacctaatagggaatggtctctgtgacaggtgtaaaattccattccttctagaaaattactcacctagcagatgctccttctgactgaaagagaaatttcattgcaaaaagaatgttcaccttttattatgaatattgcacaatgcattaagacaatggctttccatgtagcagtgcataaccttgatcttctgaccactaatgttcattgtataatacagataacaaatattcacctgtctccattcttcatcagtgaattgcaaggacacttggattctaatgctgagggtccctggaagtctgagaatgcatcatagtcttaggctttttcaaaagtgtaaataggttagtgtgctaaagacttgcattgaaaatagagattgctcagaaaaaaaagaattgtatttccactgccaaagagaagaatcaagatcaagaggaagaaactatttttataccacagtgcaaagataagaaaccttcaacctattatttggatgtggccctgggcttaacttggtacaacttgaagcaattttctgaagtatgtacccttctccccctacactgagccagatacatatacagacaattttgttgagtccaacatgaatgtggtgcgaactcaacagagatctctgggtgttaaaaggcaggccccatgccccgagatggcctttgagagggagagatgctttgcacagagtcctaattttcccagggagaagttgggtgggtgatatcaacgacagcagtgatagagactgcatcacccttgggctgagtgtggttaagtttgggaagaagtcagagaaagtgtggggttgctgaccttgggtgtgcccagctttctgagtgctaactgggaggtggcatgaagatggcaaagctggaagtggagaaggagcaaaggcttctgccaacagtgtctgatgtatggtgaggcggaccatgctggttgtgctttgtatttcttttctctttcttctgtgtttctctcctccttcctctggcttgattttattctctctccttctttttcctggggtatgagtgacaaggatggacttttgagaggctctgaacttgaaatttcagcaaagagaaggacctgtggtttgtgtaagcatctctctgttgtccagatacagaacccccaaaacatcgagagtggcttctcttcctcttttctctgcctcccatccaatccaagatctctcaatatgcactatttgtgttatcttctttgaaaggtccctctttctctgagtcttctctttcccttagttcctttctccattatttagacaaaaatgagagtaaactattctttattcactttcgtttgttgaacagagttttgccttttattttaaaagcagttgagcaggatttttatatttcttgcccataaaacctaaaccttgttaacatttttcaagttagttttagtccacttagggatagttgctctcaagagataaaagattacccatacctatcccttttgtgggctttgtatttcacagatctattgaaaaataccatttataataaaagctagcaattattgagcttactctgtggtaggaacttaatctgcatgatcttatgtaatagtggtagccgccccacggggctgtgtgatgactgagtgagcccatgtatataaagtgcttagtgcagtgcctgacagatagcaagctgtcaataagtgtgctattaatactgttattagtactactacgatgaagttactggaataagccacagccagtggccttggaaaaacaaagttaagggtctaatcaaccaagactcactagacagagcaaagtagctggtaataggatagtaaatgttcctgggatatggcagaggaacaatggtctggaagcaacagaaggagtaaggaataggctgataactgtccccactgccatctccggggataaggtgaagctactttaggagatggtctcccttttttttttccattatgagaggttatttttaattctattaaattccaatgtttattcagaaaacctggtagagattgaattgctatatgtactttcttagttttcttcttcatatcatattttgaccatttatcttctacacctggctgacctgcatgttccttgtagtgtaacttctacttggtgtttgtgctttgctttgttttcaaatttaaattgtgagatacattttctaagaaatagccctgatattgaaatggcttctgtggaataggtttgacagatgtaagtctttgattctttggctttggtttttgtgcctgttacagttttacacacattcattcagaggaagacattaccatcaatgtgttgtttcttttttcaaattccagtatgttttcaaagacccgtatttcactaagcagtgtacttgttgaaactgatgtgagtgactttatgtttccacacgtgatagagcatcagatactggagtttgccaggggtagaatggttggattcaggaatgtttagctgactcattgcaggaagttaccctgtaatcccagctactcgggaggctgagatgagagaatcacttgagcacaggaggttacagtgagctatgatcacgccactccactccagcctggatgacagagcgagacctgctaatgaaagaattatgttccaaaagccagctaagcattttctttaaatgagaagagtctgtgtttcatggcagcttgaaagagggggaaacatgaagaggaaataaatgaagactatctcggtttattaaggacactgcaaaggattctgatgaacaccaggtggagaggatgcacagggcaacgctgtggggaggggcgtgggatggtctctagcaagattggctatagtagcgaattaagagcacatctagatttggatttcagtgctagctgtgccattcataagctgtatgaccttggataaatcgcttaactattcagagttctagtttcctcacctgtaaaacgggagtgctaatattaatggaacctagctcagatggttgtgtggtagcatatgtgagataataatatgcatgaagtaagcttagcatgccttctacctaataaatgaatgctgctgctattgtcattatcattccaatcaccctgcagagagggtatgtttgtcttcattttacagttgagaaaactggggctacaggaatcaataacttttccaaggtatagttaataggcacaaggctagaatttgaccagagatgtctctgccccaaagcctgtgatctttctactgctctgtgatgcctctggaaacagtgttcttattccagaaatgagaagcacaaggtcagctctcacttaaaatagtaacaaaaacaaatcctaatatgttccttagcctgtgaggtacactggctgctcatttcacttgctttcaactacagggaaaaagagctgtttgtcacctgtggtttgatggagctattttttttttctcctctaaagctagcttccccttttcactaaattagtgtcatttccatgaaacaaaggtgtttccgatgtttcagccttttcatttctctctaagcatccacttcttgaaggtttttattttcaggtagatttactgctgccccaaacacaaggacctcaagtctaagcattttctggagccttgatatctttgggagaattgttactgctgagctccgattgtacaggaaattttggacatcaaattttcaggagacctgtatgcttctctcatcccctacatgataccacactcacaaccttggcttcaattttttggcatgtggctttgctggttctggcatctgatactctctgtagcttcagtgttgcttctttttttgaaatagcatgctcttttaggtgttgctctcgcataccttgtttagtactggtggcatatggtgttcctacagtcttaccattcttacccaacagaggagtcaaaaggggaacatttatctggctgagcttggggagagcaaggactcagtaggtttaatgtctcaggaaaatgactggaatcatgagtagaaatcattataaattgcacagtctgaatttatttgacagaaaattattgaatgttcatgatgaagaaagcattgtgctaaatactccaggaatacaaagacatggcatctgtccttccagagcatatgagttaataaagggcaaaaacagtattcaaagtatttgtggagtttgaagttccatgaggagattataccctcctcccaaaaccaaaaattctgtagggatccactgtctataggaccagggaaagcttcacaaaggaagtaatatctgatctgtctctggcatgaaataggtgcccaagaaatattcattgaattgggtttagacctgtgaaatatgagaaagggccttgtaagtggagggaatggtgtgagcaatactgcagaagcgagaattgtcagaatgtatactgggaacagaaagtattttaggccagattaaaaagtatatatcagggagggattggggagggtggtggcagtgaggcccagatggaggatcatgacctggaaagccaggataaggagtttgtccttagtttagccgacattagggagccactgaagatttttgatggtaagaatgataaatttatttcctaagatagctctgatggcagaacaggtggccaatgcttttttaaacaaacaaacaaacaaacaaacagtagttgaggagaggtcaggagagggaacatgaagaaaaaagtcacactagttggtgatcaggatgcattgaagaccaccctaaagaatccatttggtagaagggtggagttagaggccagatttcaaagatttaaaggaatgagtgtggtagtggagggaaggaaagcaagcttcagcaacttgagaacccagaggcctgaaggaaaagcttgtggagtctagagcatcactgaagtcagagaggaaggggcctgcagagggaggcactagaaatgagggagggactggccaattcatataaagagatgacagaggaggaggctgagaggggaattagtggaagggtttttcttagaaaggaggattttttttttttcagagataggactgaaggaagagagactaaaggaaatgtattaaggaagagaatgagccacgagaaaaggaaagagtagcaaaatcttatttgggtctacatatagagccttgctgtcttggcagaatgctcaatgctcagaacacccttctgaaagcttgcccgccatccgggcttcctccacaagattcaaggtctcattgattctcttcagcttcagtcagagacaatctgacagctgcagttggctcagcccttcttgcagcaagctgacaccatttctggtgggcttcaaaggcagtataaatggttctcccttaagagcaggttacactcggcacctaggcagcctcattacacaactaattaaacctctatcacttgaaaggaatcaatggcagttcaagatctgcttgagtagactttgcatttccgtgttcacacatagcagtcctacagtcaaggagttcccaaccactgcaaggggaagatgtaaacaagaccttagaaatagattgtttcatttcctataagggggtgtcccagaagatcttactcattagacagtaggcaagacccctttaaccttttgaaatagaagggagtttcgggcagctctttaaacggtgggaagctcaagctttctgctctggtgcatccatctggacaaaggcatgtcaacttctcagagtctgtccttcctggcagttccaaagggaggtccccgggtgttgagtgcagtaagctagagcctgggttttcccctacagaaaggctccagccctgttgtaaatacaactttcagaaactaatttaactggttccacttaaatgaactgggaaatgacccaatagaaggggacagagggacttgtgccagttctaccatcgcaacaggagcagccacaccagaccttttactttcagcaggagaatgttgactttctgaatgcaacacacttttccatctacttactgtgttatttaaataaattgctttgctcttgagggaccttatactctttggctcagtgagaagctggtagattggagtcagaaggggctgtcaatgtggaatctaatagagtttcagtgtgggaatattaggggtcagaagcaaccttacattagttatcacatcttgtcattagatgacatggatattattataaagaggaaatctacagggagcgtggagatgaaagccataaattggctagaagaagtaggagatttcaatgtgaaagcaagtgcttcaagatgtggactgcctgtggactgccaaactgccctatggactgcccaggctccctgctctactctcatctcatatcactttttactccttgaaatactgtcaagtttggattattcactgtcctcagatgacaagggttcagcgccaacagactaattttcacgccggcctaaacagacttaattagggaagctgttctgtggccaaaaatcacccagtgcattccaaagccagatctaacaggcttgtggattttcaattgtttgtcatcatctgtactactgctttccttctttcatgtaggacaaggcacacaggaacttactgttatcctggctttgccactgaccagctgtgtgaccttggctaactaacttaacttctctgaacctcagtgcctcttatgtaagccggagataataatggtactgaccgggcatggtggctcacgcctgtgatcccagcactttgggaggctgaggcgggtagatcacctgaggtcaggagctcgagacaagcctggctaacatggagaaaccccatctctactaaaaatacaaaaattggccaggcatggtggattagaagtcccagctttcgggaggctgtggcagaagaatcgcttgaacccaggaggtagaggttgcagtgagccgagatcgtgccattgcactccaggctgggtgacaaaaacgagactccgtctcaaaaaaaaaaaaaaaaaaaaagtacttaccactgaggactgttgtgcatgttcaatgaagtaatgcctttgggagtggttagcacaatgcctagcacacagaaagcactaagtgattatagttgtctaacgataacaataacagctgctgaaggcaaacatgtgcccggtgtggtggcttgcacctgtattcccatctacttgagagcctgaggcagaggatcccttgaggccagtggttcaagaccaacctggcaccatagtgataccagtgtgggcaatatagcggtacctcatctctacaaaatttttaaaaaataataaaaaataataaagcaaatatgtaatgaattggatgtgtgtgtttttgaggggtgattcgtttcatttgccctgattaagggtgctttgaaaagaaaagaataaatgtgaggacagaggagtaagtaaagacatatatatcccacatgtctattttctttgcacctgagggtttcataattgagattttaaactaagttagagtgagaagtgtaaaataatctaccctcgctgaagtcctcaaaacttaagactgtaaagaacttctgtgtttagtcactcataacttacaacatcactattactattggtaaaaatatatatttttcaatatagaaagtgctggtacccaggggcctctactgggtgttagctaaggtatgcagcatctcacttctctttgatccattacttttttaatgggcacattagaaaaattggcacctgggtaacctgaaaaatgcagtctttggggcccctatcctcaggagattcaagctcaggaggattagaatgcagtccaggaatcatgggcaccatggatgattgagacaccaagggtccaagagtcagacttggaaaactgtgggttagtgggagccagcctcgccctacccccatgcacccctggccatcccatgctgcccaaatcattctgtggtctgagatcccctcatatcctttagttggcatggctttagagcatcagtacacctcgactcatctcctgcagaatagcaaggagtccttaagcaaggttttccctctcctcctgacatgagcccccttagcaccctgcatcattaccgtaattgcttcccaacttctgattagataaaaacatgatggcagcaatcatgtttcatctttaacttgtaattggatgcaatatgatgattatggatcctgatcaaagggcatttccatgggataataagtcctcacaacagcaatctccttgggatgtttttgcttttgccttatggctgcatgtcctgtccccatttcccttcccccaaaaggagagcatgacttcagcatctgctgatgattttgcctcaatttttctcatcacacacacacacacgcaatctcatttggtgcatctgttgttaattagctgtctctcatggctagtccttgggctcgctccttcctccaacaatccctctaaacctcaagatcacgtaaaatgaaatggaaaaaaaaaagatctgtgaatcatttctgtagaagactaatttttatcttcctccaccagtatgtagcatctcttttccttccttttgtccttccaatggtctcttttctgcattaacagaatcaggtctataggtctctccctccttctcccccctctccctttttctttccttctctccctctccttcccttaacatctctaaatgtaaacttgttagcaaggtagagtgtaaagagcccaggctcagaagtcgggtagtaccagctgccatttactggctgtgtgaacctgggcaaattatcttaactctctgagcctaaggctttttgtctgtgagatgggaatcactgtgcatatggtatttttgtactttgcagtacgttgtttggaggaataaattatacatatcgaagtgttaggctcagagtgagcacttgataaatgctggttattgttttaatacatacctactatataggttgtttgttttgttttgttttagtgtgttttaacgagataatgtctgtaaatagcttagaacagagcctaggtagttgcacaacaattaactgctcccttaccatttgctttttttgttttttttttttgaaaaaatgggatccagaatgggaagaagaacaaacaccattggattcaaaacccaatatttaaggactcctcataagcaggccattatgcattaatgtagtcacattgtcaaatgtctccatgtctccagtgcacctgaccttatcagtgcaatgacaacactgtgtgtaccactctagagcttggtgattgttgacacaaaagttacttttggaaatcattatctaccctacacttctttcttttcttatccttgcctctatttaccttgtataaccctcctggtggcattcaagactggagaagatgctaagccaagtggtatatccctatgccatccaccatgtactttattgaatttgatttttggcttaattttctgtaattgaaaaaatcatggaatatcagagtttagaggacatttagagaccgtaagttcaagccactcattttacagtttagggaactgagactcaagatgtcaactaatttgtttagcaccaggtaggggattgatgacatagctagggctagaggccaagtccctgacatctactcaagtgcttatccctctgcagcacactatttagtagattcttttatttattgagctgtaagttacaaacagttctgttccttttatctattgcaaaagctcccattttatttatttttattttttctgactctgccactgttacaggttgaactgtgtccctcaaaaatggtatgttgaagtcctaacccccagtacctcaaatgtgaccttatttggaaatagggtcattacagaggtaatcaggttaaaatgagatcattatagtgaagcttcatccagtatgactgatgacttataaaaaggggaaatttggatctagagacagacacagaaggaagatgatgcaaagacacacagggagaagacagtcatgtgactggagtgatttatctataagccaaggaatgcaaagtaatgccaaggattgccatcaaataccagaagctagaagagacaagaaagattccccccaaaccttcccccaagaaccactggccccgcagacaccttgatcttggacttccagcttccagaactgtgagacaatacatttcttttgttttaagccacctggtttgtggcactttgttacagtaaccctaggaaactaatataccaccatggatagttttgttatccccaagaggtacatattaaggccagagagagaaatttgtcaagagaacatgtatccagcacacaagaattgtttgccttaaattatattatgtttgtacttgggaaccaagtcaaatgtcggtggtatcagtgttaattgttgtctatgccatctgtactggtcagggttctccagagtaatagaaccaacaggaatatatatatatatatatatatatatatatatatatatatatatacacacacacatatatacatatatatatacacatatatacatatatatacatatatatacacacacatatatatgtacatatatatacatatatacatatatatacatatatatacatatatatatacatatatataatatcatatattatattcgtattaggccatatgaaatatgacctaaactcactgagcctcatatatatatatatatatatatatatatatgattttttttttgccaagcatcaaagccaagaaattcatactaacgactaccttcttctccatcctggcactggtacagtcactaagaactgtcaatacacatgcagtgttaatctacgctggtaatactcagaccagatttcatgatagatgcttgacagatttcatgatagatttctctctctctctctctctgtgtgtatatatatatatatatatatatatatatatatatatatgcacatattcctatatatattcctatatatatatattcctatatatatgtacatatcatggaggctgataagtctcacagtttgctgtctgcaagatggaggcccagtaaagctggtagtgtaattcagtccaaatctgaaagcctgagaaccaggggagctgatggctgagggcaggagaagatgaatgtcccagctcaaggacatgaagagtgagttcaccgttcctttacttttttggttctatttgggccctcagcgaattggatgatgccctcttgcattggtgagggtggtctttatgaagatcaaatgctcatctcttccaaaaacatcatcacagacacacccagaaatactgttttatcagccatcttggtatcccttagcccagtcaagttgacacataaaattaaccatacaccttctactgaaactgtaagatcattttattgtcgtttcgttgcttgtgcttattctgagacttggaaaatttttgaggaacatgctttggtttatggctgcatagggtagatgtgctggccagtggtgttcttctaggcatagttatagtttttgaggactgttataagtcccctacttgtgtggcgctctccaggtatgcctttgttccctcatatttctttcaagcttatgcatctgggcctggctaacataaggtcctttatattaatattgttgccttgctgatacagctgtcactgtaatctcacaggacagtgataggatccagggctgattttttttttttttttgccagcatcagagccaagaaatcatactaacaacaaccctcttctccaccctggcactggtacggttactaagaattgtcattacacatgcagtgtaatctacactggtaatactaagagcagatttcatgatagatgcttgggaagtttcataaacagggatcattgtttttaatcctcttgatggtgttttcccagagctgtgtttggaatgctactgaaagttagatggctaacagcatgctatgaagactgcattgagatcaaggagaagaaacaagggttagttatctggctatgactgaagcaatcaacggtgaatattggtggaactttacgaacggacattgctaatgggcaccgtggtgctgaatgaatacaacatgagctttggcaacacccagatgtaggtttgaatgtgtgactttagaaatgtgacctaaattcactgagcctcagattttaaacctatgaaaaattccaaacattttaaagttaaaaaagaataagatagcaagcataaatgcactcactatgaagtttcaaggtatattgcaagatgtattacaaatacagccgtagcctcatgtgtatccttctccaagcacattgctctctctgcccctaccctgccactctccccagtcccaccacatatactcaaacaattaatgatgaaaactcaaaaagacccagacacatagaaactaaattacttctgaaatggcaagggttggtagagactctccttgcaaggttaattaatatatctgacaaagaaacagcaaaagggcttgtttagggaagtcatggatggtatttctacttttaaaatataaattagaattttctaggaaaatattagatttctagtaggctacatagttttctgaacaagaccaggttagttcatcactgtaatgagggctcagtacagattggctgtatgtgggtgtgatggttaattttacatatcagcttggctgagtcatggtgctcagatatttggttaaatatcattctgaatatttctgtgaaggtgttttttgttttttgtttgtttttttgagaaggaatcttgctctgtagtgcccaggctggagtgcagtggtgcaatcttggctcactgtaacctctgcctcctgggttcaagtgattctcccacctcagtctcccgagtagctgggattacaggtgcccaccaccacggccggctaattttttgaatttttagtagagacagggtttcaccatactggccaggctggtctcgaactccggacctcaaccgcctcggcctccccaggtgctgggattataggcatgagccaccacgcccagccctgtgaaggtgtttttgggtgacactaagatttaaatcagtagactttgagtaaagcagattatcctcctttatgtgggtgcgcctcatccaattagttgaaggccttaaaggaacaaagactgatcatccctgaacaacaaagaattctatctccagactgcctttggacttgaaatgcaacatcaactcttccttgggtctctagcctgctggcctgccttgaagattctgaacttaccaatcctccataatcacatgtgagccaattccttgcaatctctctctctctctctctccccccgccccccccgtctctcgctctctctctctctctccccgccccccacccctctctccctttctttctctgtgtgtatatttgtatacacatcctgttggttctgttttggaatgctgactaatacagtggttaatcttttgctttccaaagggggaaatggtgaatactctctgctcattttattggtgcctatgcttccaatatatttgtacagctgtacatgctttacaccttatgttactccgcagtgcaaaagctctccatggctgcctctgtccaccaggctaagtaaaaatgccttggtctggcattccaagctgtccacagtttttctgtcctctctgtccttatactcttatgctctgaataaattgtatgaaacacctctgcatgtgacttttcttaaactggaacagtattccctctgctttctacatttcctaagcccaactgcacacaaatcctactgtgttttgggtcattttctagaagctgaaaatttgtggggaacaagacagatatggtcccttttctcatagattttacacactggtgagaaagacaaagaacaaacaaataaataagcaaatataataattccagacaatgattaggattatgaagaaactgaaatacagtaatacatagagtggcagagagtgctaccctagattagtgtccagaggtgccttcactgtgggggtggtattggagcagctgtggcctctgccctcatagatctcacaacctaattgaggacacagaaacatatacagaagctgtaatgtgggagcttgagtgttatcatatgtgattacagagaagagctacttaacatgggctggggtgggacagagaaggcatcctggaggaagtgacatttaggctgggatctaaagcataattaggagttaggtaaaaaaatagtgggggaggggaagacatttcaggcagaaggagtagtttgtataatgaataaccagagatgaggaagagcctggcctttgggaaaactacaaagagttctgcaggttgaaacttagacatgagcataggaaggtgaatgatgaagctggagaattaggcggggccagattatcaaaggctttgtaggtcctgctactacagtttcaggtgctgagacaggttttattattattattattattgttttctttctgtgtgtaagcaagctgaggcctgtggagggtaaataatctgcacatggtttcatagctagtaagcagcagagctgggattcaaacccaggtttgtttgattctactataccacgtcaccttgtaagaattcaatttgattataattattcaattcttcatacagaaccttgagtagtctggtttggctggaacatatggcatatacatatatattttctaggaaaatattagatttctagtaggctacgtagctttctgaacaagaccaggttagttcatcattataatgagtgctcagtacacattggctgtatgtgggtgtgatggttaattttacatatcagcttggctgagtcatggtgctcagatatttggttaaatatcatttaacaggaatgggacaggaaactgaaaatgttcagtgaggccagattattggggggaggggtagttaaatgcatgtctgagaaatctacacttaagtatcttgattttacagataagaaaactaatgctcaaagaaactaagaaagttgcccatggttgcaaatttagtaagtggtggaactggaattcaactgaggtttaactggtgccagagtccaagactgtgccaaatcctcaaaactgtctttctaccttaccttcgaccgcttcctctccactgactctatctactcaggcatccaaaaaaactccacatatattgagcacgtactgcatgccacaaactgtacaaattgttctgcattcaatagctcattataaaatgcatttgctctcattttatacatgaagaaactatgtctcaggtaaattaacttgtctaaggttgcactgcaaatacatcatgtgaatgtttatataatggtaatagttgaagctccagtagtagatgtggtcactgaggaagataatgaggggtagggtaagaaagaggagaggagagcaaaaggaaaatgagacggaagttgtcttggtcagccagggctgccataaccaaataccatagactatggggcttaaacaacatgaatttgtttttcacagttctggaggctgggaagtccaagatcaaggtgctagtcaattgctccctagtgagggtgctctgtctggattgcagacagccaccttcttgctgtgtcctcatatgaaagagagaaagcgaactctgatctctcttcttcttcttagaaggacgttaattccatcatgagggctccatcctcatgatcttatcgaaagctaattacctcccaaaggtctcacctcctagtaccatcacattgggagttagggcttcaacatatgaatttgggagatggtggtggaggacacagttcagtctatagcagaaaggaagggaagggaagggaaggaaagggaagcgggtggggggaggggactaactgagaacagaacttgggagaatgcccacgtaaggagagagaacgaggcaaaggggccagtggagacagaaagaatgatcagaggagtgcaatgccctggaggatgtgacagggaagaagcttccagggtgaaggggcagcaccaagtgtgttcattgccactgagtcactgctgtagacagggtcacatggaagtgcctagatgttggatttggttacctgggacgttttagagtagttgcaactggcagaatggtgagggctgaggacagacagtagaggactaaagctgagagaacagagcacaggtggatgcaacggtttcgtagagactggacagagaggacaggggagatctctgtttggttgaagaaaactaatttgggatgggggatactaagtaattctgaatgattgacaggaagggggtagtacagaagagactgagggctccaggaagccagtgagtagaagtggtgaataattaatggagtgagcagctggggagctgagaggaggcagggctgaaagcagagtcagagagtctggctttgggcagaaggatgtgtgtagtgcaatggacacaatgcaggattcagtgaattacagacttggttcttggttctactacttactatgaccttgttcaagccacttaatctctgtcagcttcattctccatacctggcaaatgggggtaatgagaggagctatatcttagggtagttatgagaatccactgagctagtggacaggaacgcacccagcacagggcatggcatctagtgggtgcttgataaagggacaataaataaaaatgcagagatattgggaggcgtgagactgagttaacacatatgaactgggctcatagttcaacaggcagcctagattgcctggattgggtcccatagtgctctggtctttcttcttttttaaataaggactcaaatcccatcatggtggtaccatccttctcacctcatctaaacctaattacctccaaaaggctgcacctcctagtaccatcacattaaaggttaggtcttcaacatatgaattttggttgggggcacaattcagtctacagtggaagatgtgttagtgctgctcaccacttttttttttttttgacagagtcttgctctgtcgcccaggctgaagtgcagtggtacaaacacggcttactgctgtttcaatctcctgggctgaagtgaatcctcccaccttagcctgctgagtagccgggattatagacatgtgccaccattctcagttaattttttaaaaagttttttagagacagggtctttctatgttgcccaggctggtctcaaactcctgggctcaagcaatcttcccacctcgacctcctaaggtgctaggattacaggtgtgagccactgtgcccagtctcaccaatattgatgatccctttcctcctgggctcagaataggactaaacttttctcctttcttgaagttagatgtggccacgtgactttccttggcaaataaagtatgaaaaatgcttctaggtggaaacgttattggttgtgaactctccagtgctcttttcctctgacttatcaaatagggagaacttactgataatggaggtgcaatgcagagccaccaagtggagaaggacagttgcccttgacagtcaactagacctgcagtggactgtgtgggaaagagacaagctccttctcttttaacccactgagatcttgaaattgtttgttattgcaacataacctggcctatcttgatttatatgcccccaaaagtgaaagcaaagtgtcccctaattcaatacttggtaatgtctttgaggatacgtatgaaaagtgaacataaagttaatgtgactggtttttaacaacttgccagaatttataatctctcaaattaatgttcttgtcttcaaagtagtcactgtgggattatataataatttaaatgatgtacaaaacagttatgaaattccttttacaacccaacctcaaaattgattaacttagtcatttgctatatgcctggcactggggatacagagatgaaaagctgtgttctctccccttcaagagctcacagtgttgtagcaggaaatatgtaagtgatctaaagtgtcttaatgtatggtagggccataggtgaggaaagaggtcagttctaccacagagattcacaaaaggctctatagagaaggagtgactaagcgttcactagtcagatagattggggtggaggggacagatagattggggtagagggaccaacaggagcaaaagcgtggagggttgaagtagtctggcccatttggataggtgcaaatgcttctgtgtgtctccagcctagtataagaaggggccgctggaagacatgaagatagagaagcagggaggggtagatcatggagggcctgctatgccacactgaggagtttgtagtttaatctataagagagggagaacaaatgatgggttttaagcaagggagccacatgacttttttttcttttggatgggaatagaaaaatacatttactattgcaacaggaaaatattgctatgtacagtctcactaccttctaagaacggtgaattccaatcactagttagtccattattgatgggttgagtgtgattgatgcaaatttggagctgcctgaatagaatcaactgctctgcataaaagagggagggggagataaattagttcatggctggggaaaggaaagcagaaaaggaaagggagagagagtgacagagaaactcaagacaaaggtgtctaatggagattttgtatcaatgcggttgctgtttggttttctatataaaccctcatttctctacagaattgccagctaaatctgccctgcttacctgtgctttgtggagaggatttgctatttagggatccagctaagtgctgattgttacttcaaggttagcgtggggcaaaataaacagaagtcacacctggagacaatcaacatctaggctatatagtctagactctggcttgcccttgtgacttgttttggccaatgagacaacagcaaacttgatgccggcagaggcctggaaaagcactttcttgcttgcttgcacctgtctactttcccccttgctcctctgccttcaccataagagcatgcatggactagacttttgaataatgagaaacatgtggcccagtgaccccagttgcttcagctgacagccaactgccaggtgtgtgaagtgagctcagctgagaccagaactatccagccaggcccaaccaagatcagaagaactgctcagctgatctggaggctcatgataacaaatgagtggttattgattttttgccactgagtttcggggtgatttgtcacacaggattgttgtaacactgggtagttgatacacatgtcataaaagtaacccacacatgcctctgccatagtcagaatagtgaggaatcaggaagctgccacttcaaccgttggctccaaattccagtttctagattcataggagttgaaagcagaacacaggccgtccattgtgctagcaaagattgtagcataggcagtgtggtcctggggccagcggttcaaaaccttcttctgcagaagaaaaaaaagagagagagagaggcaccggtgtttgtttagctggaaatcagtgatggctttcaaatacctcaacgtgtcttactcttctgaaaatgttaccttgactcctgtggtttttaagtacgagtctctttgcttccttaatggtctctatactgctttcatgttttgtcctatttttgcattatgtttaagcttaacacaccttccatgttatgtggaggtagatctgaatcccaaatcagagtatcatgaaaatactgaattgtaaagctgaaagagacctttgcacatcactaggagtaaggacatcagtacagcccactcgtagaggtgggactttgtccttaggtcctcccaaacattctctcatgcttaactttccaatgttttttgtgtgtgggggtgtgaggtgaggaaaggtttgggaagctacctaaagcaccatgctctagtgtcagattcagattctagggatccagttctcaaacaccacatctaggtgtgatatggtttggatttgtgtccctgctcaaatctcatgtcgaattttaagctccaatattggaaaaggggcctggtgggaggtgattggctcatgcagtaggtttcccccttggtgttctcatgatagtaactgagttctcatgagatcttgttgtttaaaagtgtgtagcacctcccactttgctctcttcctcctgccccagccacataagatatgcctgcttccctttcgccttctgccatgattgaaagtttcttgagaaatccccggtcatgctacctctacagctgtggaacagtgagcaaattaaaactctttttttttttatcatatataacccagtctcaggtatttcttttttttttaattattattatactttaagttttagggtacatgtgcacaatgtgcaggttagttacatatgtctacatgtgccatgctggtgtgctgcacccactaactcatcatctagcattaggtatatcgcctaatgctatccctcccccctccccccaccccacagcagtccccagagtgtgatgttccccttcctgtgtccatgtgttctcattgttcaattcccacctatgagtgagaatatgcggtgtttggttttttgttcttgcaatagtttactgagaatgatggtttccaatttcatccatgtccctacaaaggacatgaactcatcattttttatggctgcatagtattctatggtgtatatgtgccacattttcttaatccagtctatcgttgttggacatttgggttggttccaagtctttgctattgtgaatagtgccacaataaacatacatgtgcatgtgtctttatagcagcatgatttatagtcctttgggtatatacccagtaatgggatggctgggtcaaatggtatttctagttctagatccctgaggaatcgccacactgacttccacaagggtttaactagtttacagtcccaccaacagtgtaaaagtgttcctatttttccacatcctctccagcacctgttgtttcctgactttttaatgattgccattctaactggtgtgagatggtatctcattgtggttttgatttgcatttctctgatggtcagtgatgatgagctttttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattttgtaggttgcctgctcactctgatggtggtttcttttgctgtgcagaagctctttagttaaattagatcccatttgtcaattttggcttttgttgccattgcttttggtgttttagacatgaagtccttgcccatgcctatgtcctcaatggtaatgcctaggttttcttctagggtttttatggttttaggtctaacgtttaagtctttaatccatcttgaattaatttttgtataaggtgtaaggaagggatccagtttcagctttctacatatggctagtcagttttcccagcaccatttcttaaatagggaatcctttccctattgcttgtttttctcaggtttgtcaaagatcagatagttgtagatatgcggcgttatttctgagggctctgttctgttccattgatctatatctctgttttggtaccagtaccatgctgttttggttactgcagccttgtagtatagtttgaagtcaggtagtgtgatgcctctggctttgttcttttggcctaggattgacttggtgatgcaggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatattcttccatttgtttgtatcctcttttatttccttgagcagtggtttgtagttctccttgaagaggtccttcacatcccttgtaagttggattcctaggtattttattctctttgaagcaattgtgaatgggaattcactcatgatttggctctctgtttgtctgttattggtgtataagaatgcttgtggtttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtagtgagagagggcatccctgtcttgtgccagtttgcaaagggaatgcttccagtttttgcccattcagtatgatattggctgtgggtttgtcaaagatagctcttattattttggaatatgtcccatcaatacctaatttattgagagtttttagcatgaagcgttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgccaggctttggtatcaggatgatgctggcctcataaaatgagttagggaggattccctctttttctattgattggaatagtttcagaaggaatggtgccagttcctccttgtacctctggtagaattcggctgtgaatccatctggtcttggactctttttggttggtaagctattgattattgccacaatttcagatcctgttattggtctattcagagattcaacttcttcctggtttagtcttgggagagtgtaagtgtcgaggaatttatccatttcttctagattttctagtttatttgcgtagaggtgtttgtagtattctctgatggtagtttgtatttctgtgggatcagtggtgatatcccctttatcattttttattgcatctatttgattcttctctctttttttctttattagtcttgctagcagtctatcaattttgttgatcctttcaaaaaaccagttcctggattcattgatttttttgaagggttttctgtgtctctatttccttcagttctgctctgattttagttatttcttgccttctgctagcttttgaatgtgtttgctcttgcttttctagttcttttaattgtgatgttagggtgtccattttggatctttcctgctttctcttgtgggtatttagtgctataaaattccctctacacactgctttgaatgcgtcccagagattctggtatgttgtgtctttgttctcattggtttcaaagaacatctttatttctgccttcgtttcattatgtacccagtagtcattcaggagcaggttgttcagtttccatatagttgaggggttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaatgtatattctgttgatttggggtggagagttctgtagatgtctattaggtccgctaggtgcagagctgagttcaattcctggatatccttgttaactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaatttatccctttaccattatgtaatggccttctttgtctcttttgatctttgttggtttaaagtctgttttatctgagactaggattgcaacccctgcctttttttgttttccattggcttggtagatcttcctccatccttttattttgagcctatgtgtgtctctgcacgtgagatgggtttcctgaatacagcacactgaagggtcttgactctttatccaatttgccagtctgtgtcttttaattggagcttttagtccatttacatttaaagttaatattgttatgtgtgaatttgatcctgtcattgtgttagctggttattttgcacgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccaagagatccgctgttagtctgatgggcttccctttgagggtgatccaacctttctctctggctgcccttaacattttttccttcatttcaactttggtgaatctgacaattatgtgtcttggagttgctcttctcaaggaggatctttgtggcgttctctgtatttcctgaatctgaatgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcgtttctttttattcttttttctctaaacttcccttctcgcttcatttcattcatttcatcttccatcgctgataccctttcttccagttgatcgcattggctcctgaggcttctgcattcttcacgtagttctcgaggcttggttttcagctccatcagctcctttaagcacttctctgtcttggttaatctagttatacattcttctaaatgtttttcaaagttttcaacttctttgcctttggtttgagtgtcctcccatagcttggagtaatttgatcgtctgaagccttcttctctcagctcgttaaagtcattctccgtccagctttgttccgttgctggtgaggaactgcattcctttggaggaggagaggtgccctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtacccggccatgtgaggtgtcagtctgcccctgctggagggtgcctcccagttaggctgctcagggatcaggggtcagggacccacttgaggaggcaatctgcctgttctcagatctccagctgtgttctgggagaacctctgctctcttcaaagctgtcagacagggacatttaagtctgcagaggttactgctgtctttttgtttgtctgtgccctgcccccagaggtggagcctacagaggcagggaggcctccttgagctgtggtgggctccacccagttcgaacttcctggctactttgtttacctaagcgagcctgggcaatggcgggcgcccctcccccagcctcgctgccgccttgcagtttgatctcagactgctgtgctagcaatcagtgagactccgtgggcgtaggaccctccgagccaggtgcgggacataatctcctggtgtgccgttttttaagcccctcggaaaagcgcaatattcgggtgggagtgacccgattttccaggtgccgtctgtcacccctttctttgactaggaaagggaactccctgaccccttgcgtttccggagtgaggcaatgcctcgccctgcttcggctcgtgcatggtgcgcgcacccactgacctgcgcccactgtctggcactccctagtgagatgaacccggtacctcagatggaaatgcagaaatcacccatcttctgcgtcgctcacactgggagctgtagaccggagctgttcctattcagccatcttggctcctccctcccaggtatttctttatagcagtgtgagaacggactaatacaaggtgaatgcttggagcaaccaatcccaaatgtccaaattcaatatcagttcagttcctctagttatgactagtgtatctccttaaacttcacaaaagatatttgttttcttaccttttgtattttacagaatttattcagggttcctttcttgtactctacttaagtatggacaaaacgttcttgaaatttcaggcagaatggtaatttacataagaatgtcctgatttgtaggaaatgcatgctaaagtatttagaggtaaactcatgattcctgcaatttacttttaaaaagttcagcaaaaataaaatatatacatctattatttatctatgtaaggcaaatatggaaaaatgttaacaattgttgatctaagtagagggtatgtgggtttgcattgtataattcttcgaactttcttgcttaaaaaattaaaaaaaatatcctataaagaaacttctggcctagatggccccaccagagttttaccacgcagtcaaataacctaattatatatgcagagtaactaatgtttcaagtaatttttgaacacaacactctgactatagatatttagtgagataaattctaaggacaaggaaccagaaagacatcttaactttcctcattgtttattgttaatagtattttattttgaaatcattttatgcatatcataggataaagcaaataactatattaatgtttttaggaaccgatattttcactataagagaaaatagttagaaatatgttatgttgatgggagatacctagaggttcttgagattctgtttgtttccaggtgagcatgtaagaatcactggccttgatactgcaggctgagaactctggcagcaacttccatgacttttgctcaccaagctcttccaacagatatgtaggtctctgtttccttgtattaaaacctttcatacttggaatacatagagtggctcctgttttcctgaccaaactctgattaatagagaaggcctattttagttgtggttcatccctaccctaacttagagccctttagaggctcgacttcatgtggattgggtttgctgtaggactccttaccttgagtgggacctgggccttgacttctctgcaccttgccccttgaggccgtagaactgatgcttaaagtattcagtaccagcaaatattcacagagtaaaagtagttcctcagtccatttgggctgctataacaaagtgccatagactgggtggattaaacaacagaaatttctttctcacagtcctggagcttggaagtctgcgatcagggtgccagcacgatcatttctggtgagtgccctctgccaagttgaatactattgacttctccttgtatcctcatatggcagagagcagagagagctctctaggatcccttttatagggcaccactcccattcatgagggctctaccctcatgacctaattgcctcctaaatgccccacctcctaatgccatcacattcagggttaggatttcaacatatgaattttggggtgagggacatacacattcacttcataacaagtggctttggtgtactgatattcagcttacttctctgggaaatttgacctggcagttcccacattatcttttttttttttttttttgaggcagagtctccctctgtcaaccaggctggagtgcagtggcacgatctcggctcacagcaacctctgcctcccaggttcaagagattctcccgtctcttttaatcatgtaaatattttaaagggagggaatgtttctgtgttttatggagcattttttgttatttttggcaggagggttcatccgaataacctagcctgtcactaaaggaaatggaagccctcagaagctcttgaagcttaatccaaggaggttctacagggctatgctaatgaaaagaattttgtgcaccctggcaaatcagtggaagggatctattacatttaaggcaacaggcgttttcagagcctctccatttaaagcatttatgcagctctctcattcatgatattatccttcctcataataatggctttaaaaattcagtacaataaggtttcaattctttgcacttacaaatttaactcattcatagaccccccgaaacccatcagtgggtcctaggttaagaagttgtcacttagaaaaatatctaggccactcaactctggaaaccagtaagcccacagaaacggagctgaaagaaatgggcagatgtgttttatacacctgttggccactaggaacgctgcagcccagcaagccgaaatgctcctgttcatacagtttcagattgagctaagttgccttcttcccgctgcatctacacttgagaaacacaaagtatattgatgtggcactagcctaaaataactgtttcctgttgaatttactttcttggatcttaaagatgagaagaacagagtgtgaaattgagcttgttcacatgaacagttcctggagttccaagctgattggaagttaattcttcagccagagaactctctcttcgcatctttcctatcccttttgacaagaaagcaagtggaaattcacaaatcttattgtcagaatgaagactccccctttaagttttttctcctgcatcttgaatctccatggattataatcttaagaaaacaggggctccaaatacaacttgggtattcttccctctaatattgtaacagaaggagttcaggagagaatgcaaggaagttttattgatgtgatctcacatgagtattttcaaaggatgatttgggcgagggtccaaaaactgagatgagatgatccttctaggttgaagggatactatttttcaagtcactttttaatgtaaattccatcgcttactctttttgcatgacacgttcattgtagaagagttagaaaatactgccaagtaaaaagaaataagacgtggttaatagcaaccagcatttattgagcacttaccatgggccagacactgtattacatctcatttaattctcaaaccagtctgatgactttagtactcattatgtccatttcacaggtgtagagaatggggtccaaggtcccacagttaagaggtggtggagttgagatgtgaatataggcagtctgagtctggagcccagtcgcttaccactgtgcttttatatttttattccaagtgctgttacttagagaagcaactgattacagaggaatcagagtcaaggatctgaatttcaggtttggcttagacattaattagctgttagaacctaggcaccttgtttaatctcttcctgtgacactttcaaaggctctcagttgccattagcataaaatcaaagtttcttagtctggcattcaaaatccctattcagttctggtttgtctactgttcctgaatatcaaatccacttgaactttgcttgcttttactctactaatgctttagggttgatttgttatatcctgagttacccctaagcaagccatcccctccacccatgtcttagccctgattaagcttattcattattcatgaaaaaaacattgagtgcctaccacattccaggtagtgtgctagacactaggaccataacaataaataaggtggtcaacatcccaggtctcaagcatgttacaggttagagaaaggaaggaaggctaaatgaaataaacaaaacaaaacaattaggactgcaagttatgattaagtgccatgaaggaaaaaataagacaggaacctactttagatgggatgatctggaaaggtctttcagaagaggtgacatttaaacagagctataaagaatgagaaagagccagcattgttacaattgggagaagagcatgtgaaagaagaaacagcaaatgcaaagccctgagggaaacacaagcttggttttttattacggaccaaacagaaggccagtgtggctatagagcagagtgagcaagcaccagagtgaaaaaaaagtgaggctaaagagttaggcaggactagttcatgcaaggcatcataggccaaggcaagcagttcttggttttgtttattaataaaattaaaagccatcgaaagctttcaaacagaggaatagtataatctgctttgctttttgaaacaacaattccttcagttcacatgtagaaggtggttttgggagagttggagtggtggcgtaagaagacatcttaccaaaactgacttaagaaggaacaaaaaaccctgcattttcttacaagcattaaatatactgaatttgctattaaaaaccttcctgcaaagaaaaactccaagtccagatggcttcaccagtgcgttctaccaaatattcaagagtgatagccaggtatggtggtgcacacctgtaatcccagctactctggcagttgaggcacgagaatagcttgaacccaggaggcagaggtggcagtgagccgagatcatgccactgcactttagcccgggtgacagagcaatactctgtctcaaaaaaaaaaaaaaaaaaaaaagaaaagaaaaaaaagaaagaaaaaaagaatgaaataattccaaacttatacaaatttatccagagaataagaaaaggggacatttctagctaattttatgaagctaaccttgataaaatctgaaaaagaaactatgaaaaaaattataggccaatttcattcatgaacattaatgcaaaaatcctaaacaaaatattagcaaattgaaactagcaatgtttaaaaatataataaccaaattgggttcatattaagaatgcaaagttgctttaacacacacacacaaaataaatggatgtaattctgccaccttaacaaattcaaggagaaaaatctgatgtaatctcaatagatggaagatgataattgtcccttaagtcaatctataattttaatataattaagacttattataaaactgtagtaattaagacagggtagtattttcataggaagagacaaataatccaatgtaatagaatacagcacagagagatacatactgtacatgctttgacacttcatatacaactgaaatggcatgagaagcatgcatttttgattaataatgcagtaaaaactgagtataggacaaaaatgaaaattgacccctacaacacaccatatataaaaatcaactttaggaagataaaggaccaaaatgtgaaaaagcaaaacttttagaacatgggaggctacctttgtatcctcaggataaagaagagtttataaaagaaggaaaaagtagcagaaccaaaggaaaacattgatacattcaactgcattaaaattaagtacttctgtttatcaagatacatcacaaaagagtgaaaggactggccacaaggggagagaaaattttgcagcatctatgagccaataaatgactcatatccagaatatacaaataacttctgaaaatcaacaagaaaaagacagacaacctaacagaaaaattagcaaaagacttaaatagacagttgataaaaggggaaattcaaacagccagtaaacatgaaaaggtactcaacttgattggaaaatgcaaatgaaaaccgtaatgagaaaccattacacacccatttgataggcaaaaattgaagcctttcaggagtggaagttcagggtgtggctgattaaggagttaggcaaatccactccctaaaaagcaaatataaagctaggctaaatcatacaagcgaccattttggcactttagaaactaacctaaggtgtacatgaatctgagaagaacttatgcttgaaaaactgcttgactttgggtaagaacattgaaaatctgtggcctagggatgctcctatctcatatcagttccagtgtggaggaggttctgtcagatcttgagttggcagcttttctgccaaggtcaaggggcaggacccattctattttgagaaaagggcagtgcccatgcttagcatcactgtcaatggaactgatttctaggaggctggccagtgggagaaggccagtggattggtcctattagtctgaggtcgtggttgtagttggggtaaatgtatttcttgttttaaaatttaaattgtaatcttagattcagggggcacatgtgcaggtttgttacatgagtatattgcatgtaatgatccaatcgcccaagtagtgaacatagtacctaataggtagttttccaaccattacctcattccctacctccccacttttggaatccccagtatttactgttcccatctttgtgtctgtgtgtgtgtggccaatgtttagctcccacttataagtgagaacatgtggtatttggttttctgtttctatgttaattcgcttaggatagtggcctccagctgcatccatgttgctgcaaaggatatgatttttttctttttgttgctgtgtagtattccatggtgtatatataccacattatctttatccaatccaccattgatgggcacctgggttgagtccatatctttgctattgagaatagggggcaaacatatttatagctgagcccgctcacttgcacagcagagatctcaggaggccccaagctagtcacccactattgaccaaccttgaggcttataggcaaaagtgcctggcataaagtaaaaccagagacagatctgaaaacagtctgactttgaatgccatcttctatcaaggcaccgatccacaggtgatactggcatgaggtgtttgagcacctctgattaccaagctaaacaaatatagagacaaccactaggaagccaggcttaaaaataaaacaaaaaataaaaacaagagtatcgaaacataactgagcagaggcatcagtggccacatacttgcaccatgcaagggtaaaagatttagcctaagcaaattaccaaccaaagaaataaataaataagcaaaacaacaatagaaacctttaggaaaaaactatcagaatacagagtggctacaacattgatcaaaaatggccaattgtcaagaagaaaacattacaagacatgaaaataaataggaaaatgtgacccatacccaggaaaatatacatcagtggaaactatatctgagtgtccctaatggttggatttaggagacaaagaattcaaagcatctgttataaatatgtataacgaactaaaagaagacatgttgaaataattaaatgcaagtatgacatcaatgaatcaacaaacagtctcaatatggagttagaaatgattttttaaaggtaattctgaagctgaaatgtataataacagaagtgaaaagttcactacaggcgcttgagcagattctggatggcagaagaaacaatcagtggagttgaagataaataatttttttttgttttttttgagatggagttttgctcttgtcccccaggctggaatgcaatggtgcaatcttggctcaccgcaaactctgcctcctgggttcaagcaattctcctgcctcagcctcctgagtagctgggattacaggcgtgcaccaccatgcccggctaattgtgtatttttagtagagacggggtttctccatgttagtcagactagtctcaaactcccgatctcaggtgatccacccgccttggcctcccaaattgctgggattacaggcatgagccaccatgccggccgaagataagtaatttcaatagaaattatgcaatacaaacaagagagaaataaagacagaagaaaaaaaaaacagagcctcagagacctatggtataacattaagcctataaataatatacattatgatgggtgtagagagagacaggggcaggaaaacagaagaaagggaaagaggcaaaaaaaaaagccttgaagaaataatgtccaaaaacttcccagagagttgatggaaaatatcagtctataaatctaagaacctcaacaaaccccaagtgggataaatacaaagaaatccatacctagtcacatcacagtcaaactgttcaaaaatgaagaaaaaaccgtgaaggcaacaagagaaaaaaaaaatcttgttatgtacaggggagcataaatacaattatcaactttctcatcagaagtaatagaggccaggagtcaaggggatgatatgttcaaagtgttgaagggaaaaagctgtccaataagaattttatttcttataaaagtatcctttgaaaatgaaggtgaaataaagacatttccagataaacaaagactaagataatttgttgttagcagacctggcttataagcaatccttaaggacttaaggaagttcttcaggttgaaaggaagtgacaatagcagacaatttgactccatagggagaaataaagtatggcacaaatggtaaatatgtagggtattatgaaagattctataaatatatatcttttttcatttctcctctttttttaagcaacataaaattgtatgaagtaacaattataatattgcattggcgggcttcaaatatacagagatgtaatatatattacaaagaaataaataaataaagcaagaaagaataaatgagactatttattttcatgtcttgtaattttttcttcctgactactggccattttcgatcaattttgtagccactctgtattctgatagttttctcctaaaggtttctgttgttgttttgcttatttatttatttctttggttggtaatttgcttaggctaaatcttttacccttgcatggtgcaagtatgtggacactgatgcctctgctcagttatgtttcaatactcttgtttttatttttaagcctggcttcctagtggttgtctctatatttgtatagcttggtggttggaggtgctcaaatacctcattgccggtatcatctgtggatccgtgccttgatagaagatggcattcaaagtcagactgttttcagatctacctctggttttacttcatgcttttgcctatagacctcagggttggccaatagtgggtgactagcttggggcctcctgagatctctgctgtgcaagtgaggaggctcagctataaatacatttgccccctattgtcaatagcaaagatatggaatcaacccaggtgcctatcaatggtggactggataaagaaaatgtggtacatagatatcatgtgaatagtctaaataacctaaacaaaaaatagagattgtcagattggattaaaaaaataaataagatccagctgcttacaagagacacactttagattcaaagacacaacaggtcaaaagcaaaataatggtaaaagatataccatgaaaacagtaactataagagagccggagtgggtatattaaaattagacaatctagagtttaagagaagaaataatattctaggaaaaagataaacatttcataaggataaaagagtcaatacgtaaggaagatttaatagttataaatgtatatgcacctaaaaacagaaactcaggataaatagacaatttgacaattgtagttggagattttaatactctcaatcattgatataacagttaaacagaaaattaacaatgacatagaagacttgaacaatggcatatcaaccaacgaatatttatataatattacacccaacagttacagaataaatattcttttcaagtacacatggaacattgtccatgataaaacatatgttaggccataaaacaagtcttagtacattactgaaatcatacaaagtatcttctgtgattacaacataattaaatgagaaatcaacaaaagaaagaaatcttggaaatctccgaatatttgaaaattgaacaacatacttctaagtcacccactggtaaaagaagaaatcacaataaaaattggaaaatattttgagtggaacggaaatgaagacataatataccaaaacttatgggatgcagctaaagcagtgctttgtaggaaaattatgactttaaattactatactagaaaatgttataaaagagtcaaatcaataatctgaatttatacaatgagaatctagaaaaagagtagcaaactaaatccaaggcaagcagaaggaaataatgattagagtggaaatcaaggaaagggaaaacagaaaaataatagagaaaaatcaataaaaccaaaagttgatctttgaaaagaccaacaaaatcgacaaatctttagctaaactaacaaaataaaagagaaaagacagaacttaccaaagtcaggaacgaaagagagcaccactattgactctacagaaattgaaaggactataagagggtatgttagtttcctaagactactataacgtattattaaagactgcgtggcttcaaacaacagaaatgtattctctcacagttctggaggctaggaagtcaaaaatcaaagtgttggcaaagccacactctttccaaaaactctaggagagaatctttccttgccttttccagctcctgggggttgctagcaagcctgggcattccttggcttatggcagcataactgcaacctctgtcttcacgtggccttctccactgtgtgtgtctcctctgtgtcatcacgtggacttcttaggacaacagtcactggatttagaatgacctcatcttaactaattatatctgcaaacatgctatttccaaataagatcacattctgagattatgggtagacacagatatttgggggacagtattcagtctagtacagggaatattataaacaacatgatgtcaacaagttagacaacttagatgaactgaacaaatttctagaaagacaaattaatgaaacagattcaggaagaaataaaaaatgtgaatagacctgtaagaagtaggctgggagcagtggttcatgcctgtaatcccagcactttgggaggccaaggtgggcggatcacttgaggttaggagttcgagaccagcctggccaacatggcgaaaccccatctctactaaaaatacaaaaattagccgggtgtggtggtgggcacctgtaatcccagctactctgaagactgaggcaggagaatctcttgaacccgggaggtggaggttgctgtgagccgagatcataccactgcactcagcctgggcaagagtgagactctgtctcaaaacaaaacaaacctataacaagaaaatgaaatgttaggtaggtgcaaaagaaattgcagtttttgccatcactttaaatggcaaaaccacaattacttttgcaccaacctaatagtaatttaaaaattccaaagggaaaaattcatgtctaaatggctccactggtgagttttatctaatatttaaagaggaaataataccacttattcacaaacactttcagaaataaaggaaaaggggtcacttcccaccttattctatgaggccagtatcacctgataccaatgtctgaaaaaggtatctcaatgaaagaaaactacaaaccaatatccctcatgaaaacagatgcaaatatccttaacaaaatattagtgtggaaggcagaactctaacatgatcctccaagattcctggcccttggtgtacatacatattttatcagttatttaataaagcactaatctaggcattgttgtgaagggattttgcagatgtaatgaaggttctaaatcagttgactgaaaaggaatttattcaggttggcctggctaaataacacgagcccttcaaaagcaaagagattcctctggctggtctcagaagggcaagtcagagattcgaagcatgacaaggatttgacatgctgttgctgcttaaaaaagcagagagcagggaataccagcagtctctaggagctgagagcaacccccaaaagttagccagcaaggaaattagtacctcggtcctacaataatagggcactcaattcttccaataaaaacttggaagcagatattttcccagagcctgcaggtgagactcagtctggctggcactttgatttcagccttgtgatatccttagcagagatcccagtcatgacatgcttgacttctgacttacagaactgtgagctaataaatgggtgttgttttaggctgctgactttgtggtaatttgttactcagcactagaaaactaatacaattagcaaaccaaattcagcaacatataaaaatgattgtgcaccatgacacaaatgagatttattctagtgatgttagattggtttaacatctgaaaatcaattagtgtaatatactatattaatagaataaaagacaaaaaaccccacaatcatctcaagataggcagaaaaagaatttgatgaaagctagtgcccattcatgatgcaacaaaccaggaatagaagggaactttcttaacctgatgaagagtgtttaccaaaaatatccacagttaatggtgaaaacaatgctttcccctaagttcagaagtgaactgcaatggcaaatctcatacattgccaatgagaatgtaaattggtacagatacataagaaatagttcatcactatctgatagaagatagaagattcttatgacccagcagttcaactactaggtgtgtctcctagaatatcttttatatatgttcatagctacattgtcatagccccaaactggaaaaatgcaaatgtccatcaagagtagaatgaataaatcaattatgatatctttgtacaataaaatccaatatagcaatggaagtgaacactaaatttacacctaccaacatagatgaatctcacaaatacattgtgtaaaataagtaagtaaccaaagaatatataattccatttctggaactttaggcctaactaaactatattgcttaaggatgtctacatagatagtaaagttacaaggaaaagcaagggatttattctacaaaatttagggtagtgattacttctaggaagagagaaataatgtgatgaaggggtaacataacatgaaggtgcttttaaaggactggtagtgcttatctgggttaatggatgttcactttgtaatcattctttaaattgtgcatatgttttatataattttctacatgtatgatatatatccctattaaaagtttaaaaaataatagaaaaaagatgtaattaggtggtagaatgaaaggaactagtaatgattgttgtagggtgttaggaaaagagaagaatctgggatagtttccaggctcttggagtaaggttgtgacagtggagatggagagaagtggctggactgaattatatttagtagacaaaaatggcaggatttgatgatggatttgatgtgaaaagttaatccatggggaggaatcaaggataatatctaggtttctgatctggatagtaaaattggtggaggttattcagtgaagtaaggaacagtgtaagaagaagagattaggtggggaagcctgtgagacatccaaaaagcaatgcaacataggcttttgcttacataagcctacagaactcagtggagaggtcaaaattactttttaccaacattggcaaatatagctaacatttattgaatgcctatcatgtaccaggcatttcacacacagcatctctttaagctttttgacaactctgtgaggccagtactattattatctctcctttatcaaggagccttagagaggttaagtaatttttctgaagtcacatgattggaaagagtagagctgggattagaacctcaagaatctgactcttgagcccatggtcttttgaaaccctgggccaaagaaattcagtcacagaatgctgattaaagcatataggactaatgacacatggcttttgtggcacccagtgcatgggtctgcgttagtatggaaatgttcctctgtagttagttcagggctttgataccagccaatcccattaggtttctcatcttttatcttctttggcatctccccaaatgctaacctctctggtcattctatcttaagcctcatctctggtcattcttagaccaccgtgcgctcccttcacaccaactcaaccctgaattcgctcacctactttcttctctaccaactatttccatggtgccttctgaggcccttagactggatcctggctctctcccaagttaaggacttgctgtgatcctctgagtacttgctgcccattcttctatgaccctgaactacaggatgagagtaaggtcagaattatacttgatttcaagtgccatttccaaatgacctttcctctttaaggcacatgccgtttaaatacactaccttctattctttcttactgctatcattttgtaacctcacttttatttggtgaagaatttgtcaccgagatcgtgatcttcatatccatccaagtgccatcattttggatgatccatccaacttcctggtctttcccttctctactcatctttaactccacctccactccacctcagtcattccccacaagaccacacttcagaatttgtcatattccatccctgatatctaatcctctgagactcctctatccacagttttttactttctaaagcctctcactcttatgtccatacatatccatttcctgatctaatagaaaccacttagtttttctcctaatttactttgttttcctctgtagtacagacctcatggttcatcacatcagcccttgaatcttgcttttattcttacacctgcctgctcaccatgtgaaatccaactccaaaccaattcagacatccaactcttttgttcctcttcctgggctgctgagcactgctggaaaaaaaatcacacaattgttcagatttgggtcagtgcaaattcatagtttctaaccttagtgggacccttggtacttcgtgctaagtggctgcccagctgtcctactcttcatcgtttgtcagcatttttccccttctcttcaggggctattttcaaaccttccagtcttctcgagccctttactccaccactttcctccttaatttcagaatataaccttgattcttactacacatgataaatagaagccaccaaatgggaacttcctcaattccttgctactaaacctagtaatctatttacatctacacatattgaacttgtttccctcctattgtcagagacgagtccctccgactttgctttggatcccatcagagccattgctttaccctccccaccagtattttagggaacttacccaatatattatcatttctaactcctatgcattaaatcatctcccctccattgaacgcttgtttaacaagttcagagatatcccatcttaaacaacaaacaaccaaaaccaaaatgaaataaaacttacttaaccctgaatatctctctttacttttcatcccagcttctccagaggaagacctacattcaccatattcactttctcacctcccactttctctttaattcatcatcactagccttctgctctccccacccccactcctcatcacttttctgagttcaagtcaagggttccaatgagtacctttttgtcaagctcagtggactctctgcattcccacctgactcaatctcttttggcaattaatgactaccattccttttttgaaattatctttacatttcatttcaatggtggcattctttcttgtttttcttcctatctctctgattattcctcagtatcctttgcaagttttttttcagcccactccttaaacactattctccctaggatttctcttattttttatactctcaactttaagttcatttaaaccattgacttcaattaccaccctgtagctgaaggtacccaaatccacgtctgcagccccagcctttctgatgagctctagacctgcatattcaactaactagtagacatctctccccaaacataacatgtccaaaaccatagtcgtaatttcaagccaccaccccaacattctccttctgtttttcctgtctccatggatgacattttattatatcttcaagttgctcaacccagaaatcaaagtctcattctattgttttctctttcattcactacccacatttaaatgtttaaccaaattcagtagattctgcctgcttgtcacatctcatattcatctgacctttcccttcctactgtcactgccttagttcagttcttgttctctctcccctgaaatagcctctgccctggcctccctacttccatttgcatccctcaaatccatcacacctatagtagacagataacctgattgtatccgttccctgctcacaaccatttaggataaagtctgaacaatttagtatgatctgaaagaacttccacaatctggtgcctaattcatttattcatttcttgcttctctagaaccttatcctctagcaatgtgaagttactggaagtttcttgaacacaccatgctctctcaatcctccatacctttgtgcacacattccttctgcctgaatttcctgccttctgcccacacagagtccactcagatgtcaccttccctttgttgccttcctagagtcccccaagctgtcacaggcacaccttcccttttgcatccattgcttgttttatggacctccattacagcagttagcatattttcccccaattgttttttgtttttgtttttgttttcacatcagaggtcaacaaacttgtggctttcaggccacgtcctgccttcaggagttttgtttggcttggatagtggagtttattatgtgaaggatataaggactaagctcatgtttccttctggtaacagtcatttagagctaagtagcagtcgcctccttttgactgcacttgcactccccaggtcatcttagccctgcctctcatttcaacttatttgcctcacaagtttggatccttcgagtactttggtttcttgctccttgtttacaggtacatcttaaacctgctgttttgggatcactgactactgtgatctgcatgaaagtggggaacatgatttgtttcctgttgtatttatcctggttctcagaatcacctgctacgcagtagacagtgtttgtttgatgaatgaatgttctctctatctggaacactgtgttagtttggattattgattctaatactccactcatccctgtgtctttccctttgccatgagactctgcagttttttgttttgttttgtttttggagacagagtctcactctgtcccccaggctggagtgcagtggtgcaatcttggctcactacaacctccacctactgggttcaagcaactctcatgcctcagcctcctgagttgcttgctcccgagaagcaagaaatgaaggcacacaccacctcacccggctagttttttgtattgtttaagtagagatgaggttacaacatgtgggccaggctggtctcaaactcctggcctcaagtgatctgcttgcctcagcctcccaaagtgctaggattacaggcatgagccaccgcacctggccagactctgcagtttttttctaccctttgacttcagacttcaccatttgacttgctttggccaataggacattcatagatatgacgtaagcaatgacttatgtgatcaggctagtgcttctgccattgcatgaaaagaacctactctgggtagcccatgggtccaaggaggatgagagaaatgtggaaaagacctgtctccatagccaccatttggagccaaacccagatgaggtcagctgatctctgggtgacactcagacatatgagaagtaagtgtttgttgttttaagccacaaattataggatggtttgttaagcagcaataactaactgacacatatgcccaatcttcacttcccaagctttcaaaatacggcccatcctcagttcatttcaataactgccgcctaatattcagttatgtcattgtcctccaaatttttatagcacattattattattgttatttttaattttactttaagttctgggatacatgtttagaatgtgcaggtttgttacataggcatacatgtgccatggtggtttgctgcaactatcaacctgtcatctaggttttaagccccacatgcattacgtatttgtcctaatgctttccctccccttgcccccaccccgacaggccctagtgtgtgatgttcccctccctgtgtccctgttttctcattgttcaactcccacttatgaatgagaacatgcagtgtttgattttctgttcctgtatagcacattatttttaaaaagcagagttcttatgatataattcacacaccacacaattcacccatttaaagtatacaattcagtggcttttagtatattctcagagatgtgcatccatcaccgtgattgattattgaccattttcacaccttcctccactcattaaaaacctcacatctcttagccatcactcccaaaccccactccatccctagcaatagacatccacaaatttgtcattgtgggtttgcctattgtggacattccatatgaatggaatcatgcagtatgtggccttttgcatctggcttctttcacaagatctgttcatgttgtccatgtatcagtacttcacttctttttattgccaaataatattctgttatggatatgccacattttatttatctattcatcagtttatggacatctgggttgttttcacttctttgttattatgaataatgctgatataagcatttatgtacaagttgtttgcatgaataatacttcagttctattgggtatatatcaaggggtggaattgctaagtcatatgataactctgtttcgctttgtgaggaactgctatactctttcccacagtggttgcaccattttacattctcaccaacagtgtatgggggttccagtgtctccacattcttgctaacacttgttattatctagccatcctactgagtgtaaatggtgtctccttgttttgatttgcatttccctaatgactaatgttgctgagtatcttttcattggcttataggccattattcatttcttctttgtagaaatgtctattcaaatcctttgcacatttttaaattgtgttattcgtttttatttttgtggttttttttttttagactgagtaacattttcttcatcactcatgtggcatttaatagttactgtctggtgttgatagtatttttttttcatgtgtggacaacttattttcccatctagacagggaactctttgagcacagggactgtctcatatctattgttttccttactgcagctggtgataaaaatatcaccactccccagagctaccacttattgaacccttgatatattctaggtacagtgccaaacaccttacatatattatcttctcatttgataatcatagcaattctgtgaggttgttataatctccattctacagattaggcaattgagtcaggcagaggttgagacatctgctcaaggtcacatagcaagtggcatagaggggactcaaaagcaggtaagtccgactcctaacttgctttttttgttttatttatttttgtttttgtttttgttttttttgagacagagtctcgctctgttgcccaggccggagtgcagtggcgccatctcggctcactgcaagctccgcctcctgggttcacgccattctgttgcctcagcttccccagtagctgggactacaggcgcccgccaccacacctggccaatttttttgtatttttagtagagacagggtttcactgtgttactcaggatggtcttgatctcctgacctcgtgatccgcccttctcggcctcccaaagtgctgggattacaggtgtgagccaccacgcccggccctaaacttgatcttttaaccactaaagccattgcttcattatgtactgtatgctagtatgatgtgtgtctcctatgcatatagtgggctcacaataagtacttttgattaattagcctgtaaaatgcagataataaattctacctttatctcataaagtaagtcccacaaaagtgcttggaaaatacccaatgttcaataaatatgacacattttttggaatatttgtttatggattgtgcaaatgactgaaaatgtatggtggtaatgctgacattcacaagttgactgtcgcataatgctatcatcaagtgtcataatggaaaagttccagcctttcctaaggactacattttctctgagacactaaaatctggagttgaagaattctccagaggctaacctccatgtagacctttcatgccaccttgctgaaaagatattcgtctacaattctcagcggctttcttccccactcctgaagcttctatcgacaacatccctctcatctctttctctccctttctgtggatgcagctcggcctacccgacatctaaccatgctaatagcctctcagttgctatgggggttctttggaataagtcaagctgttggaagctttgtctgggcaaagtgtgtagctgacatctaaaggaactattccctgaggtcgggcactcatcccaacagaaaaggaagagctgccaaacctggaggcagtgcgcagtgtcgtgttttcaaagcttgctgaatttcgaatagcaaatctgaccatgcatacaaagaaaggtgatttaatattctgactacttcttccctcccctaataccatctgcagcagagacacagtagccctcctcctttttattaaaaccaagactattgtctcactaaagtaaaagatcctcatgtctggtcccagaattctgtgtgttccctacccaaggcaagaatggacccaaggtgcagaccacttagcaagcacgtttatattcagggaagtgtgcagagacagaagaaggctgcaagtgaatctgctaggggtagataagagctgcaggtcaccagcaccacatgtgacctgcttgtgatataagccacgtgctttatgctgtaattcttgttttacaaggcaataaagcaggggatgcggggcgggggtggggggacaaaaagtgcttttcagtgagagtgtattttggtcacgtcgtccgcccttttcttttctcttcataaatccggcatgactggtttagtcaattggaagttttgtgtattgtttggcttatgtatgcacagtgcctaggctctgtctcattatgctgatgttagcacaaattactgcatgtgaggctccgtcacctagagagggacacaggaaaggcaacatgtcacagaaaaaagaaaattaagttaggtgtttacccttgctctccacctcactaaaatagtataaactttgatgactgattgtcttaacatcacatttagtgtttttaaaagatgttttctgtgtttaacagcacagtctcttgagtcagaaaattttaagttcatatcccagctttgccacttgctagctgtttggccttgggtgattatttagcctctctaggctctgctttccttatctgtaaaatggtagtttgattcctaaaacgatgctattaactgctaaccatattgcttcattatgccctatgcaagaggatactggagtttttggttaagattaaatcagatactgcatgaaaaacatttgatacagtgcttggcacatagtattttgtaaatgctttcattgctttttctggggttaccaatacctggagaaagtatatggactgtgccgaataagagtaggcgaaggcattctgaatggagggagaaatttggggagaggtggggagcagtgtagtctcatggtaaataccatgaacattgacagcttcacctattaccagctctgtgaccttgggctagtcacaacctcagtattgagcctcagtttcctcataagtaaaatggagctaataataacacggttgtcatgaggattaaatgacatataaaacactgagcacgggctgggcacagtggctcgcgcctgtaatcctagcactctggaaggccaaggtgagtagatcacctgaggtcaggagtttgagaacaggctggccaacatggtgaaaccccgtctctactaaaaatacaaaaaattagctgggtgtggtgacgggtgcttgtaatcccagctactcgggaggctgaggcaggagaatcacttgaacctgggaggcagaggttgcagtgagctgagatcatgccattgcactccagcctgggcaacaagagtgaaactctgtcttgaaaaaataataaataaataaattaattaattaattaataaaacactgagcacagtgtttgacagaggaaatgcttaataaatatgaactgctgttatttaaaattatttttccctttgtagtttgacaccccaagttaggagcacaacagctaggtggatgccaagatattgagttgtagagcatgcataaggccgctgccgagttcaaagagcctggagaggaagaggccaaactgtaagattcatctgccccaagctcatcagggcccacattcagcatgttgtctaggacatcaaaataacttttgatgggtcctggacccatgacccatgcatgccattttggacagcatttcgcaggtctgagcctatttataaacactgtttattcatgaattttagccacttggaaagcctcctgaatcacatgggaccaaacccaaggcctttgtagcaaggggcagaaacttagccatttttcttgatctaccaagccagactttttgcaaagagttttgaatattttggagaatccgatgaaggccagggcctctttcccaaaagaatgcacataagccctaaccccctacttccctacacaatttagtacacagttttggagttttggagagttcaaagtcttcataaagtctgctatggatcccataggggttcatggacctcaggataagaatccctggattagtggaggaggacctttttaaaaattataattatgggattttggccatacagcccatcactcctggcttcagggcagatgaacagtaaattcatagactgaaatatttcaatttaagtatggtttgcttttttcttttccagaaagaaatacatgaggattcaccaaagaagtttggtttcaagagtcaaaataaaaaggctagtttacacaaagtgggttgtgggatgcttgtctaaattctttgatttggtcttatctgtggcatcctggcatgaaactgcccaagggagacttaatcaaatcctgggagattggcttatagaaatatatgtttttaatacttacctgatatacagggatgaaaattctagttaacaatccctctctaaacatacacaccttcttcttcactaaagaaaataaaagtcctaatatgaagtgttgcagatgttctgacagctctagtattttggcacataaatggatctgtgaaaagcatatttcttttttgttattaaatcagaatttcaatgtgtcctacttgctactgctgaatggtgcatttgccatacagatgttgatgcataatcaatgaacttttttaaaatgccagtgttccccatagcagaatcatcattcattgagtagggagggaggcagagctgagccaagagaaactgattctttcttgaagaatcatgctgattctctggggtccactgtacactggtcttcagagtttgagaaaacttgtgtcaggggtcccctatataaaagatcaacagaacatggaccataactaaaagatgttttactggtctcatgttttgctagcctctgtgtgtttcgtcacatgatcagcttgtaaagtccttaaaatgaactaataaaacatttaagtgtaggtagttatgtagagcccccaaaaggagggaagctgaggaggttatggccccttccataaccacaattatgggagaggagaggagatagcaactatggagaggagatgagacaaagctgaggttttgtagcctacagcaaagaaaggagcatggagaatggcctggaattgagaagggacccttatagtctttcattcagcctggagataaacatcatacatgaaattgtccaagagagaaggaacccaccagaattctgtgtggattttcttctcagatcccaaatactcccaaaggctgcaaatagaaacaaaggtgatttgatagatgagacagcttaaaaattttctgactacaaaacacccattgctggatagaatatttcattttcaaatgcatagttgagtatacaattaagaaagagaaattcccaaaagtcagagtccccccaaaagactgagagctgagtggaaagcacatgggttaaatgtgaggcttttctggcatgggagaatgttagtttcagtaatccaagggcctgagttttatagaagtttatgtaagtataggagattaatccattgacttacatgagatgatgtagatgctggcatggatgcagtgaacagagaacacttctacactgctggtgggaatgtaagctagtacagccgttatagaaaacagtgtggagattccttaaagaactaaaagtagaactaccatttgatccagtggtcctactactgggtatctacccagaggaaaagaagtcattattcaaaaaagatacttgcatatgcatgtttatagcagcacaattcacaattgcaaaatcgtgcaaccaacccaaatgcccaccaaaatgggtgcatcaaaatctcacaaatcaccactagagaacttactcatgtaaccaaataccacccgcaccccaataatttatgggaaaaaataacaaactaaaacaaaaacagaattgaggcccccgcattaaactagagccctcaaaaggatatacccttgtagctccttggagaaatggccgagtacaggtctggggcaagggaataaatattgtgttaatatttattccctctttggaatattttattgtgttaagaagagattatgtgcacaaagactaggggaatatagcaaaagaacataagaactgactcaaatgggctcccattggtcaatctgaggccaagtttagcattatttacaaagaggaaaagatattgttacaatgcagaggtctggaggactaccttaaccaagtggtcaaattatcatcatcgacaatggaacaaacatatatgtgtctttagatgtgaaataatgggaaaaacacaaagacttcaaacccgctaatataaatatgttcaaagaacaaaagtaaatcatgtttaaagaagtaaggtacaacggcaatttctcatcaaagagatctggggctgttgggagtgcgatcccaggagtgctcttcttagctgtctgtttcctggattctctctgtcaatcttgtgactgatctgccttcttgctcactgctacatttgacccctgaacaacacaagtttgaattgcacaagtctacttatacacagaattttttcaacaagtatattggaaagtttttggagattggtgacaatttggaaaacttgtagatgaactgcatagcctagaaatattgagaaaattaagacaaagttaggtatgtaatgaatatacaaaagatatgtaaatatggtttatgtgtcaatcgactatttttgttttcaggaagacttccagtcaacaataggctactagtagttaaggttttggggagtcaaaagttgtagatgtatttttgactgtgcaggagttggtgcctataatccctgcatggttcaagggtcagctgtattagtctcatgaagctaccagcattttttttttttttttgagacggagtctcgctctgtcacccaggctggagtgcagtggtgtgatttcagctcaccgcaacctccgcctcctgggttcaagcaattctcctgtctcagcctcccgggtagctgggactataggtgcgcaccaccacactaggataatttttgtatttttagtagaggtttcactatgttggccaggctggtctcgaaaacctgacctcaggtgatttgcccgcctcagcctcccaaagtgcttctgccagcctttcttaattgcttgccaccaagatctcctttttttttcctttggcactatttctggtttctttttttcctttttagttgacacataatacttgtacatatttataagatacagagtgatattttgatacatgtatataacgtataactgtaaccacccaatgggttcactttgccagctgcctagacagagccaatttatcaagacaggggaattgtaatggagggagagtaattcacgcagagctggctgtgcagaagatgggagttttattattactcaaattagtctccctgagcatttggggatcagagtttttaaacataatttggcgggtagaggcttgggaagtggggagtgctgattggtcaggttggagatggaatcataggggggtaaagtgagtttttcttgctgttttctgttcctgggtgggatggcagacctggttgagccagaatacgggtctaggtggtgttagctgttccatccagtgcaaggtctgcaaaatatctcaagcactgatcctaggttttacaatagtgatattatcctcaggagcaatttggggaggttcagactcttggagccagaggctgcatgatccctaaactgtaatttctaatcttgtagctaatttgttagtcctgtaaaggcagactgttccccaggaaagaagggggtcttttcaggaaagagctgttatcaattttgtttcagagtgaaattatgtactgaattccttcccaaagttggttcggaatgaacaaggacaacttaaaggctagaagcaagatgcagtcagttaggtctgatttccttcactgtcataatttcctcagttataattttgcaaagccagttttatgatgatcaaatcagggtaattttcacatctgtcacctcaaacatttatcttttctttgctgtgaacattgaaaatccattgtttttggcaaggccttaggcatgatcttcccatgttctcttttaaataaagtccatcatttcaggcagagctgtggagctctccatccttatggcctgactctcctcctgggcagtacttctgcaccactgtattggagctgaggtcaggggcagtggattgcttcttctggagtggcactcctgctttaccagtgggcactggggatggtggtagaccctggttttctcagcttgcctatcccatattagaacctctatcctctgaatgagctggggtggagccaattgggtaccactcctctaggcctatcatccctcagggagagcccttgcactaccagtgggagctgaatggggaaagggaagttcctgtcctctcagacttgcttaccagggatagaacttttgtaatatagggctggggaagatgagggacaccagcagcctgctcctctcaggttaaaactgtagccctggactagttgtggggaaggggaacacctgtcttcacatctacatgtgccagagttgagatttcatcgcacagatcttgttgggtggagcgtgggagcaggtagtagctcaaataccacaaactctcactgtactggttaagatttagtagattttcttggataaatgtttcttcatttgctgtatgttcttggggcaatttccagaaattctacatggtttataaaaataattttcagcacttaaattgttgttttactgcagaaacacttcgttgaactcctcacaccaccattccagaagtcctgcctgtccatgggccatttcttatatataaggaagaatgattcagtggatacaaccaagaactcagagggtggagccaagagctaagaagaatcattcccagagatcaggactgggccgtgatgaaagaactagtgatggatttcagaattgctatggaatgctatgtgtttccttgttcccctcctttgtgaactgaagtgtctactgtgattattaagtttctaactcaccattgtatgttgggtatgtgggggcatataatttgtttctttatttcataggtcctgagatctagaggctctgtactcaaggagcttcacttgaggagcctcatctccacctagacctgatttagctgatgaaatcctggtcctcagatctaatcctgatgttaaaataggctgagacttctgggggccttgggggaaggtgaatgtcttttgcatgtgtgagaaatgtaaataatttatggctagagaggagagtgtggtagacttaaaatggctgcaaattccttgtggctcctcccattgaatctggactggctttagtcactgcttgactaacagaatacagtatatgtgatgttgtagaattttagtcacaagatcacaaaaaaccttgatcttctgccagggactttttgaatgcacctgccatgctgtgaggaagtccaggtaaccacatggagaaccacacagagacagaatttgagatccccagctggcagccctagtggagctcctagctgacacccaacaccaatttgccagtaatgaagataattcattctggaagtggatactcagttccagtggaggcatcgggtgacgctgtgtagcgcagaaatgagccatccccacccaaattgcagacttatgagtaaaaataaattactgttttgagctactgttttagagtggtttgttatgcagcataaataaccataacgttccttaacctagcaactccacatctatatgtctaccttaaataaactcttgtgaataaaaaatatgaatgaggatgtttatgtggcactttatataaaagtaacgaagttgtaacaatgtgctatccctcagttggggaatggataaatagactgtggcttattcatacagtagttaaaataaatgagctagctccatctgtatcaatatatataatctaaaaatattgttaaatgatagcaatttgtaaggtacatgcagtagattccatttacatacattcaaaaatatacaaaatgatgtatgcattatttatggccatacatttttatggtaaatgtataaaaccaaagagctgattaataaacatcaaattcaggaacatggttctctctggggaggagagaaggagggagaaaggataaaagtggggctttggctgtagtagtaatgtttcacctcttttgttctttctttttatagagctctgtaagacaaagtgtttacatctgttttatcttagtggtaggcacaaaggtgtctgctatattattttctgtaatttgtatgcttagattagtcatattttaaattttttaaaattcttaaaatattttaaaaatttttaaatattttaaaatattttaaaaatttttaaatattttaaaatttttaattttaatttttgcactcattaatcactacaatatacagcgtgtcgtcaaataacatcccttctttataacactgatgaaaaaatctaattctggctggggccactgtgtgtgtggagtttgcatgttctcccagagtctgtgtgggttttctccatgtcctcctgtctcctcccacagcccaaagctgtgcacgttaggttcattggtgtgtctgtatgatcccagtgtgaatgagtgtggctgtgtgtgtgtatgccctgtgatgggttggcatcctgtccagggctggttcctacctggcgtcctgagctgctgggagaggctccagtcaccacaaccctgaactggaataaaccggtaaataattctcttacttattaatatttcttaaatgtatgtatagctcacatttatttccatgtttactattagatgtgttttgggtctttatttagaagtttggtgatttttttgaccacaaatatgccataactcttgtttatatcaattaacttgtaggaaaccattgaggactttgagttcttactgtactacctcaatttttttggtcataatcaacagtaaatattttattttattttattttattttattttattattttatttttgagatggagtctcactctgtcacccaggctggagtgcagtggcatgatctcagctcactgcaacctctgcctcccaggttcaagagattctcctgcctcagcttcccaagtagctgggattacaggcacacaccactatgcctggctaatttttgtatttttagtagagatgaggtttcaccctgttggccagctggtctcgaactcctgatctcaggtgatccatccacctcagcctcccaaagtgctgggattacaggtgtgagccaccacacctggccaacagtaaagattttaaaatcaacgttactaaaatattattttagtaacgttatttttttgtctaggttagctttttgtctggcttcttttgttcagcattaagcttttggaattcatatatgctaataagtatatcagtagtatgtccctttgtattgctgaatagtatttcatcgtatggatacaactcgatttttaaatttacctcctgttggacatacaggttgtttcctgttttggccattataaataaagctactatgaacattcatgtacaagtctttttgtggacataggtttccatttcttttgagtaaatagccaggagtggaatttctgagacatatggtaagtgtatgtttaactttgccagatgctaccaaactgttttccaaagtgcttatactattttacatttcagcagcaatgtatgagagtttgagttgatctgcatgctcaccaacacatggtattatcactctttttaatggtagccattcgagtgagtgagtagtggtatctcactgtggtataatttgcattttgctagtgactcataatattgagaatcttttcacatgtctattggtcattcctatgtgttattttatgaaatgtttgtttaaattattatccatttaaaaatattaagtagtttgccttcttattattgagttgcaagagttctttatgtgttctggatagaagtcctgtgtcaggtatttgggttgtgaatatcattttgaattaatttttgcgtatggagtgaggtaagggtggaggttcattttatgtgacatggatagtcaattgttccagcacttagctggactgtgcctggaatctgctctattttgggcttcctattatgtgaaataaatgttattaatttatgccaagaatatctgcatatattaattcctatgaccacctcccagtttttcatctaacatttctgctcagagcaacaggagaaggcataggggaattacctaagtgtgtaaggctctgcaactacacacacacacacacacacacacacacacacacatacacacacacacggggagtgagggagagagaaagacacacacaccccgcacagagattgattttctcattcttgtttagccaagtgcaatgacatacgtcatcatcatagttcacagcaaccagtgacaaaattagtttaaatcaaaaattaaatcccaaacacatctttctcacttcctttagctctggctcattttaccctgctgactctagttccttttctaattctgtaatgtaagcctttattgtctcctgctgggtgcaccataaccaccttcctggcctttcctctcctaaatcaatcctgccagactacttttttttttccagtgctgttttccctaaattgttcctaagctcagacctccacaatgtcttgttctgtaacctcatcaggttcagactattctgcctggctctcaagaccccactgcttctatcttcccaataggctggcatcctcacttttccatagacagcctgtattcattcctgcccctgtgcttttcgttcatgccattctcctctacaaagccttctgtgaactctgtagcctcatcacctttttaaattgtgaattcctgctgcataatccagtcagcctctgtcttttcttatattcactcttattgaatgtgtacatcttgtctccccaaccgggatagtggctatgtgagtgtaaggattctacctcatattcttctctcccctgcaatgctgagcacataaatgcttttctggattattttagtgttgttttttttttttttcactcgctgattagagtgaatgtcaatttgaagtaaaaagaaataacactttttacttttagagttccctttccatctctgcggttggctttggtagctttgtgctcctggaaggaggaaagatttctatgggaggaacactatggcaactccacccccaacttcttgattatctccacaggtttggaggcggatgggaggccaatattctctaattccaggccagaagtgaatgaggaagcaagagacagatggctggagaggagtattctctttcttagacatcaggaaaagccaagcaactgacccctgatttaaccgttgtttgccccagcaaagacgagggccactctctccaaaggagatgcaggcactgctgtttcctagctttaaccaagggaagggagaaacttaattgggaaaatatttttagaaatgagtattttaaaattgcacataggaaatacgcaaggagaaaagtatgcaagaaaatgcactcttactttccattttctatcccattgccaataaaagaggccctccctgcactctcaccttgcacttgagccatgaaggacaagattctgcaggtggcccccagtacctccctatagagctggggagagagtggtgttaattcctcacacgtggccccatgcacatacatacacacacaatcagtctccttggctttgtctttccttatcctttttcaaaaaaaattccagtctgatatcatcagtgatttgatgtgttctgtccatgtctcagaaggactgacccttgggtttcatccttgctggcgaggaattttagctgttcaatagcgtaacagctgtgcctggggaccatgaatcactcatgattttcagtaatctttataacaaacttccaatggcgttaaattcagtttttacatgtatgaagtctcactctgtgaagaaaaaaaaggctgtaaatacaatgctttcaaatgaaagtagtgattagtaattgactgtcatcaactttgttttgctctatggattacttcagctagaatttctggtgctgcagaaaactagttgagaaaataacaaccctttatgagcgatttcaggttttcttaccattttgcaatcttctgctttaatttgttttccattagtacatgctcaagtgtagcttaaagaaagagcactaagctggaagtgggagactgaaagtgttccagctctgccatcgtctcactctgtgactatgggcaggtcattttccttctctgcctcagtttcctgatctgtaaaaggaggggattaaacaggatagccttgaagggtccctccagctttgacgttttgccattgcaatcaaatatgccattttgatggattttttttaaaacaaaagatggaatttgtaacactggcattagctgttttttgttcttcttctttcttttctctcaataataagccttagaggtgggatttcaaaattagaatttcctacaagctgcagccataatgatagaaccatcacaggagtactattagagttaatattcttatctgtatatatctagagaagcaaataacgtttgaaaatcttttcgctgtttctctctgggttctttattcaaaggtgtttatgtaactaatgtgtcttagtggtaagaaaagtggaaatgccatgagtgaaagaaaataaagccccctcattttatctttgtcccagtctgtctttgtgattgtttctcggctaaccacctgtgttttactgctcagggagctcagcatatatcgctggcactcattcactgctaatagcagctgctaatagccttccatctcctgtcagggctgtcacagttgatttttttttttttaacatatctatgagttccatcaggtttaacagctgaaaatccagctcattaagaagcgccctaagtatttcagagtgagctagttttccagcgccaggcttgagtacagaatctggtgaaagggagtctagatatggatcaaataagaacccggagctttatgcccagaaatttgggaggagaaagggagttaaacagtaaataggataccttaagggatgggatgtgtgtttagtttgtcaaaaatacctgatgacctcatgtactccttcaaagtccacgcaggtactttaatatactgccatgtgtataaaagcagctccagaacggtgagaggtttgttaacattcatctcttcattcatttttgcaggtaacactctgggctctgttgctctttatgcagatcggacaaagaaaactcttaaaatggtttcctgctatatttgcctgctctgtttcagtctcttctgcaattccctactcacctctccaagtttgttaatattgtggtgccccaaggcttagtccttgaacttcatttcttctctagctacacctatgccttttgtgatttcatctagtattatgtattcaaatatcatcgatatgctaacaactctcaaacctatgtctccagcatggacctctcctctaaactccaggattatatatttaactgcctacttgccatttgcacttgaattggtagtcgatgtctcaaacttaacatgttaagaaactgaagtatttctcaaatctgttcatcttatagtgttccccatctcaggtagtggatccccctccttccaattgctcaggctgagaactttgaagttgttcttaactactctgtctctcttacacctcacaaccaatccatcaggaaattctgttggctccatgttaaaaatatatcctgcatttgacaactattgtcctctactgctatcgccccaaagccacgatcatctctcccttggattattgcaatatcctcctcactggtgttcttgtttcctcctctgccccctgtaacactgtattctctttttttctttattttatttttttattattatttttgagacggagtctcactctgtcgcccaggctggagtgcaatggcatgatctcagctcactgcaacttctgcctcctgcattcaagcgattctcctgccttagcctcccaagtatctgggactacaggggcctgccaccatgcctggctaattttttgtatatttagtagagatggggtttcgccatgttggacaagctggtctcaaactcctggcctcaaaccatccatctgcctcggcctcccaaagtgctgggattacaggcatgagccaccatgcccagccaacactgtattctcaatgcagctttcacagtaatggaattattttaatgggtaggcatgttacttctctgctcagagccccaccccctgccccacaagtctcatttaactttgagtataagccaaaggtcttcagggtccataaggcctgatataatctgcttcctcccttcagttaactctctgattttagtttttaataatgtccccctcactctgctccagcaaccctggcctcctttatgttcctcagacacaccaggcacattcttgtctcagagcctctgtgtttgctcttcccagtgcaggaatgcccttcccctgttaccacggctcattctctcatcttctttaggtctagtccctgccttagagtttacatagcaattatcacaatctacatatatattaattctatgttagtatatataattataattggtatatataattacatattagtatatatactacataaaatatataattatatatactaattataattataatatataaatatataattcatattactatataattataattagtatatataattatatattttatgtagtatatatactaatatgtaattatatataattataatatatactaatatataattcatattattatgtaatatgaattatatattagtatatattacatatcctatgtataatatataactatatattagtatattatatatactatatgtaatgtataattatatattagtattatatatactatatatactatataatatatattagtattatatattactaatatatataatatattactaatatacataattgtatgttagtattatatgtactatatactatataattatatataatttatataattaatatatgttatatatgatatattttaatgtatactatatatgacttaatatgttatatataatatataattaatagatgttatctatatattgctgtagtttgaatgtatgcatctttccaaaatgtgtatgttggaaactaagacccagtgtgatattattaagaggtgggaactttcagaggtgattacgtcatgaaggttccacattcatgaatggaactagctaggctaggcacttttgcccttctgccttctgctttgtgaggacacagcatttgtcttctctagaggatgcagcaacgacgtgccatcttggaagtggagaccagacccttaccagataacaaaactgccagagccttgatcttggacttctagcttccaggactgtgagaagtaaatttcggttttttgtagattactggtgtcaggtattttgttatagcagcaagaatggactaagatatatatacatatacacatatatatacttgtacatataagcatgtgtgtgtgtgtttatttattgtcttccttcactagaatgcttagtccatatgacaagtagtagaaaagttatttgtgtgtgttttgttcactgctgtattcccagcggccagagccaaggtaggcacatagtaggtgctcaatttgttgagtgagtaaatgaatgaaggcattatccaagactgggtgaccattgtttgagacccaggcctcaatgagacaatatgaagaggaaaggtcattgggacttgtcgtaatgtagaattattacttgtagaaatgtatggtctctaggtggcccaccccacctaaagaccatacatttccaagtatctgcttggatcgaataatggaattacaacactcatgtttttggtagtcaacttataataaatataaaaaatatataaaacttgtaataatggaggagcttgaagtataagcactcagtatgaacctggttgggtgggtttatactaagcaggtttggagagatgagttactgtgacagttaattttatgtatcaacttgactgggtcacgtggtgcctagacatttggttaaacattatttctgagtgtgtctgtgagggtgtttctggatgagattagcatttaaattaaattagtagactgagtaaagcagatggccctccccagtgtgagcgagcatcattcaatccattgagggcctgaatggaacaaaaaggtggaggagaatgcattatattagctctctgtctctgcctgactgcttgagatgggatactggtcttcttttgccctcagaccagaacttacaccactggttctcttggttctcagaccttcagacttggactggaactataccacaggctttcctaggtctccatctaatcaactgcagatcatgagacttctcaacctccataatcatgtgaacaaattccttatttttaaaacatgtgtatcatctcctattgattctgcttctctggagaactctaatacactttatatttattcttataatggatgtgtagtcccccatactccccaccttcatcaatactctttcataaccaatggaagaagttatggaagaaattaccaagtgtgggaggctaggcctgcaattcttggtagttttaaaaaaaattatacattttcactcctgtttacctgagaataatgacacagcaaacagtggcaaacagcttaaatttatattatctaatatttcttctttctttcagctctgctgcactgtctattggtaatcacattcttatctttgaaatgttctcttacccttttctttttggacactaagttgtactggataaatataactatgttatacttctgagaccccttttccatttactttttttttttttttgtagactgtctctcaaatctctcttttcctccttagtcctatttccattactctggtccaagccctgatcatcttatgcctggcaaactttaatagccttctgtttgactccctggcttccagctgtttttctccatgctgcttcttggcattctaattatccggcattttggcagatgtcttagtctgttcgggctgctataatgaaataccactgaccgggcatcttataaacaacagaaatttatttctcacaggtctggaggctgggaagtccaaaatcaaggtgctggcagatttggtgtctggcggggctcaatttctggttcatagatggtgtcttctagctgttgtcctcacatcaagagggagcaagtcagctctcttgggccattcctcctagatagcaccttttagctgtgtccttacatggtaaatgaggctaactagctctttgtgttcttttttataaggcactaatcccaatcgtgagggctttgatctcatgatttaatctcccaaaggcctcaccttataataccatcaccttgggggttagagtttcaacatatgcattttcaaggggacacaaggattcagaccatagcagcaagactgtggttttagaatttgggggcttaagcaagcatcagatactgcatacgatgggagattgggaaaggaggaaagaatgctcatcagccttcagactcaactagtctagagatcactaccagccctcaggtgtgcagtcttgttgaaatattctgggcagaggaaggggtgggtgtcttatacccagattgtgacttacctagggctgggaccagaaaaaacaagtacaccagcatgcaggcctcatggagactccctataattagaagggtcattgtttctaatgcctgggctacaatttttatcaaggttctggacaagagagaagcctctgcttattagcagaatcttcatggagaatccttatactttccctgtgcttgcctttctttgttggtggcatgaggagggatatagagagaggagggtgtggcaattattgttctagttgactggcactttccttctcaattttctacctctcctcccctacccctgcccagccactttggtttctcttgggcactgctctgcgtcctagtccacttacatagttttcccaggagcgtccattttgttacacgacactagcctcatggctacctggtctggacacttgaatcaagttggtcaatgagttccttcctcagagtttctgtatttgaggtcagagtatacttcagttctctctctgtgtgtagttggctttgttaaaatgtgaagctctggagttgttggtgatggcagcaagaagaaagaatgaagttataattcagatagcaatagtgacaagagacatgcagaggcctggctcattctgtggcaccagtgtagttgtttctgaggcccagggagattcctggcttttgattccctaaagcagtaatgatgatacttcatgttgacatcatgcttcaagcactttaaataacttatttaagtctcataataatcctgtgaggaagatagtattatcatttccattttacacatgaaaaaactgaggcagagggaggctgagtagcttgctcaaggtcacagagtcaggacttgtacccttgtagttagatttcattctcttcacattatacctccaatctttgtagcaattatctaaatcacccttgcctaagccagttcaaggaccctgctaccaccatccctaggcaagagacagggtcctaatagatggaattactttttgtatgcccaactttagaagtttaattctctctggctctttctcctttgttgcctcctttcttctccttttcacttgccccttcctttcttcttttcttcatttcttctcccgagctcacgctctccctttttgaaatttgtcaatcattctccctattttcttgattattcttaacaacatgcaatggtattgtcattttccatattaaaaactgctctcttgactccatttcccccttcagtttcagccccatttctatgctcctctgtacaaccaaattctttaaaagggttatgcatattcagcttgcaattcttctgcttttatactctcctaaacttacttgtcaggcgtgtgccctccaccactctactgaaactgcaagtttacaagtgacctccacattgctaaatccagaggtcatttctcacttcttacattaattgccttttcagcagcatttgacaccttcactccatccttgttcacttcctcacttggcttctaggatgctacactctcatggtccttttcagtgtcacttgttggtttttcttatatccctggccttttaatcttggcgttctcctggcctcagtccttggaccttggtcatctccttggtaatctcatttagtttcacgactttaaataccgtctgaaagctgatgatttccaactgtatatttgcaacttggacctcttttctaaccttcagattcctttattcaactgcctacttggcatttccacctgaaagagattcagcatctcaaacttaacatctccaaatctgatcttccttctcaaatctgctccttctgtagtcttccccatcttggtaagttccactggtttgtgccaagaagcttcattcttcattccactctttctcttacagcctgtattcaattcattcacatgttcaaaatacatctaaaatcataccatttctcataacttccaatgctaccaccgtggtccaaagtcacttttatttcttttcttttcttttttctttttcttttctttctttttttttttgagaaggagtctcgctctgtcgcccaggctggagtgcggtggcgggatctcggctcactgcaagctccgcctcccgggttcgcgccattctcctgcctcagcctcccgagtagctgggactacaggcgcccgccaacacgcccggctaattttttggattttttagtagagacggggtttcaccgtgttagccaggatggtctcgatctcctgaccttgtgatccgcccacctcggcctcccaaagtgctgggattacaggcgtgagccactgcgcccggccacctttatttcttaactagattattgcaatggcctccaacgggtctccctatttcctcccttaccgtttacagtttactttccactcagcatccagagtgatcctttgaaaatgctagatatatcatgtctcttctctgctcaaaaccctacgatggccccagttttcacgcagaataaaccctagagtccttacagtggcctatatggtcctattggatctgggctcctgttacctttctgaattcatcttctcctatgttaccgttttcccccctatactccaagtgtactgtactccttgctgtttttgaatacattaggtaagttcctgcttcaagaccttagcatttgcatttccctctgcctagaacacttcccttccggatatatatgtaatccattctcttacctttaaaaaatctttgcccaaatgatgtttcctcaggtgttcaaatatcaccctatttaaaattcaatatggcccaccaatattctctatcctctttcccatttttatctttttccttagcacttagtaccttctcatatattatataatttatttactttgtttattgttagtctacttgtgctatggattgaattgtgccccctcccatttatatgttgaagccctaacccccaaagtgatggtatttggagatggggcctttgaaaggtaaatagggggagatgaggtcataaggatgggccctcatgatgggattagtgctcttataagaagagatattagagagctttctctttctctcccccaacttctctctttctcttcaatgtaagactgtaaaaaagtggccatctgcaaaccaggaagagagccctcaccaggaaaccaaatcagtcagcaatttgatcttggactcttcagcctccagaactgagaaataaacttctgttgtttgagctacctagtctatggcattttgttatggctgcccaagctgatggaaacagccccctaccccatccctagagcataagctcaaggacaagaagctttgtctgattgcttactgttgtatcatcaatgcctagaatagttgtctagcatgtagtgggtgctccgtaaatatttgctaagtaaatgcatggatgaatgaatcagatatggtccttgcagagaggatgacatgtacatgagcacactatgaggtggacagtggttaagtcacatgatgaaggtacagataaagggttctgagggctcgaagaaacggagaggtcattcagagatggagagggagtgaggggaatccaggagggcttgatggagaaggtagcatttgagttagaccttgaaggaagggtaggttttagacttgtgaatgtatggggaggcacagggagttcagtctggctgaagtagtgtatttgaagagtagtagaagtggaaaatacaattagaatgaagtctggagcaaaatcgtaaaaggccctgaatgccagggtaaggagatttgtctttaggtgtggtatgaagtggagcggatatgaaggttatagaattgtcagtaaaactttgagtcatcaatcaatgatagtttctgatttaacttttggttctttactcaattaattgtctcttacctaactccaagttctttaggagcttgatgatatggttcctaaccataatagacaagaagcaaacaagaagaaagaggagagattggatatgaaaacagatatacttccagggagaaagggaaaatagctcgatggcttcttggcttgaaggatgaagatggaaccctcaacttcaggcttaatacctctgtgactgtgcaatctaataactaaagttatcagtggcagcatggatccataatgcagaggagaagtcaggacaggtctggaaccttttaacaacatgggaaaggatgtaaagtatctcagaaatgtttacaattttttttaatttaaaatgatttttaaaagattggtactggaaggggaacgtttcaactatctggtaagctcacttatattaaatactataaacaaggcatgattgtaatactggttttaccaagtgctgcatgcactgctctgtgtgtgtgtgtgtgtgtgtgtgtgtgtgtgtgtgtgtgtctgtgtgtgtgtgtgtgtgagagagagagagagagagagagagagaaagacagagagaaggctgtattaagtgaaaaacactgaattcagcattccaggtttttctctcctgaactggttcaaatgggtagaatatgtttcattagtgtattaaaactcatccacacccttgattctttgagttcctcttcatactcctcaagaataatgtctcagattcatctgtacatcccctattgtctggcagaatgtcttaagacagattaagcacttgaaccacatatgaattgaaatattgaatttcacatcttgaggcccagccacatgaaacagactgttttactggtgtgggcacaaaacttactttcttaaaaggggataagatgatgctttatgtttttctttctttctttctttctttctttctttctttctttctttctttctttctttctttctttctttctttctttctttcttctttctttttttaactctgcttggaatttcttgcctttttatgataccaaccacccattgggcagatgtcttcagggacgtcaacaacgcctagttcctttcctgtgctagaactgatggtttggagcctaacatctcgtaagcagtgtttggctcattttttcctaaatgcagtactttatacttgctcatattgaagctcatctgtcactccttcacatggaaatgcaaacttgaaggcatatcctgtcatttatgcattgacttagaatttcaaaatgtgcaaagaattagtatgccaatcatttataaatcttattgtttaaaatatattttattataataagtgattctatagagcttaccatgtgatgggcattattctaagtaatttataaatattaacgcttttaatgaagttactcctggtaccactttgggaactctcactttacctttcatcagtcttcctgctattggtgcttctttacatagagacttcaggtagaatttagtgtgtgaatttggatggaaaagttaaattcatatttttactaacctctaactgaaaattggcattttctttccttataaatgtaggctacaatctacagagatgttagcagtacctgtgcctttttcatcagcatcacagatattatcatatcacatgatattgcggatttcttgagctgtttatgctcatcactacttcggaactgaagtggttattaggcttgttgctgtttcatattgctatttcaggtgttaaaggagcatatatgttactatatcacaaacatgttttaaaaatattttgagaagtatactatttcaatatccagatggtccccaacttacaatggtttgacttacatttttcaactttataatggtgtgaatgcaatgtatgttcagtaaaaattgtattttgagtactcatacaggtttctgtttggtgctgtttttctgtttcagtacagaaacagattccatttttcacttttcagtatggtattcaacacattacatgagatattcgacactttattataaaataggctttgtgttaattttttgcccaaatgtaggctaaagtgttctgagcatgtttaaggtaggctaggctaagctatgatgtttggcaggttaggtgtattaaatgcatttttgacttatgacattttcaacttacgatagttttattgggatgtaaccacatagtaagtcaaggagcatttgtagttggtttcctttgtattttattttattcatttaaaaaatgttattctgataaggagttcatgtgcttcaccagacttacaaaggggttcatggcaccaaaaaatattcagaacccctactttatattccctcagctataacaggcagaggctggagctgaagtggggtagagatagggagaactcaggaatcttacattctcatcccagctccatcatccacttagctgtgcgacctagggtatagctcttcatcttttgagacttgttttccttagctgcaataatggtgaggaagtcatctgcccctgctagttcacaatgtgttgtgaagatcaaatgacataatgcttgtgcacggagttgctttgaaaacagcttaaagcatcatataaggtatttattgaggaatagtaacaagttaaggtttcagaggtccgatgccacagaggactattcatattcaaacagacttggagtgaatgcagttcggtagaacaccctttaatgtgtcttgtataccatttccacccaagatctgatgtcatctccatagggctctatagccttgaatgtgcatacctgtttgtataatcaattcttttctttccttctgttgccccaataattaattgctttagtatgcctttgaggtcatcctcccagatagaaaacttaagcaagcttagaacttcaaagcttactgtcaaactgaaaaactgggttgatgttatgaatcttgggaaatggtagaggagataggacctccttggccttcttgttaatgggatgtggtctatcttgtaatgggagtgggtagaattggaaggatacttagactgtatcagaagacagtagaaggaagtttccccactgtgtttggcttgggccaagcactacctaactctaatggagcattgttcagtaaaatctcctgaatttctctgagccagcaggtctccttcttttaagttattgtgtggcccattactatgaaggtagctctggtttcattaaagcattgttgatatgactattggttggataatgattatagctatttattgagcacttactttgccaggcatagtactgggcactttacattgatcaacacctcataaatgaaacttcaagggaaatatacgattttcactttaaagatttaaaaaaggctcagagaagtgacagtgttataaagtgacttggggcaccatgactgtgtcatttagcaggctcccctaccagaatataagctcttgggggaaggggacatgttgtgttcacctttgaatttccaggactaagacttgcacatatcaggtgctctataatggcacatgaatgaacaatatggggtttataataatattaccaattaggttgatatgaagattaaataaaatattggagcagtggaaagttttaagcttgtgattggagagaccaagattcaaatttcatttctgcctcttaaaaacttaagcaagtggccgggcacggtggctcacgcctgtaatcccagcactttgggaggccgaggtaggcggatcacgaggtcaggagatcgagaccatcctggctaacatggtgaaaccctgtctctactaaaaatacaaaaaaaaaaaaaaaattagctgggcatggtggtgggtgcctgtagtctcagctactcaggagactgaggctggagaatggcgtgaacccaggaggcggagcttgcagtgagctgagatcacgccactgcactacagccggggtgacagcaagactccgtctcaaaaaaaaaaaaaaaattaagcaagttacttcacatctccaagtctcagctgaaatggaggctaatacatttacttttcgcattgtagtaaacattaaatatatatatgtgtgtatatacatatacgtgtgtgtatatatatgtatatacatgcatgcatatatcctggtaagtaggaatcactaaataatgttagcttttatcattattagtgcatatgaatgtagtttatttttattttttatttttttgagacagagtctcactctgtcacccaggctggagtgcagtggcatgatcttggctgactgcaacctccgccttccaagttcatgcgattctcctgcctcagcctcccgtgtagccaggattacaggtgtgcaccaccatgcccggctactttttatatttttttagtagagacagggtttcaccatgttggccaggctggtctctaactcttgtcctcaggagatctgcccaccttggcctcccaaagtgctgggattacaggcgtgaaccactgcgcccagcctgaatgtagtttaaaatgctacacaaatactaatgtaacaaacctttactaaacacctacagcgtaccaggttctggggatatggcagtaaacaagaaaaacgagaaccatactctcatgcaacttatactctggaggtagggtgggggcatagatagtaatagctcaggtgtcaagagcacgaggtcattaccaccttatccacacaattcatgggtagtcagcactgaatattttcacaattagcttttatggctttggctaaagggtgaaagacttaagttcagtgtgtcgcagctacccttctagctttttgaaggcaggggacagccatactccttttgtgtcccattgtgcctgatagtgtttgggacagagtaaatgtttagaatatgtataaacagctgaatttcgtctcttgaagtccagcaacatgatgtggtcccacaattctatgtatgaatacaaaaacttttttttttttttttttttgcagacagactctcactcactctgtcgcccagattggagtgtagtggagtgatctcggcttactgcaacctctgcctcaagcgattctcctgcctcagcctcccaagtagcttggattacaggtgcctgccaccacgcctgactaatttttgtatttttagtagagacggggcggggggggcgggtctcactatgttggccaggctggtctcgaactcctgacctcaagtgatctgcctgcctcggcctcccaaagcgctgggatcacaggcgtgaaccactgctcctggcccacagaaacattttttaaaatgtgagtaaggtcatgaactttggttgaatcacaatcatacctcttattgagaactcactatgggccaagcactggttgagcaatttgcagacgctatcttgttcactctttcctgccattctgtgaggtaggtactatttcttcttaattttgcctgtaaggaaattgaagctcttgttgtgtccatgtgactcgcctgaagacacacagacagagactttgggcatcatgactacctaataggtgctcagcagatggtagcaactgtggtagaaaatgaagccatatctacatgatgtaccatctaagacagctgagaatcccaagggctcacacagttctactgggcgagttaaaacttctcacacatttatgctatcttttcaaataatacagtttattctgccttatatgaaaagcatacattttggggccaaaattaaaaaaaaactctatataacttgaatgcagatgtgtctttaattttctatgaaaaataaccttcatttgcattgaagacatttaacaagcaacttggtaataataaagtcagaattagagatgtcacaggactagggaaggagataaaaaaatcatttgtaaaacaaaagaaaccttccattcattattatattgaagaaacgctaactactgtatctcataaacataacaaaacagcaatatttcaaaattctggaggaacaacagaaccataaatagcactgagactttgtaggaaaaagcagcttcattaatagatttctatgatggatgaaaaggtttgtgagagatggtatgtgccacaatttgattgtgtaatataatgtatattcatatgtatatatctatgcttatctatatatagatatatatgagagagatctatttattttaaggaattggctcttgcaattatgggggctggcaagttagagatttgtagggcaggccggcaggctggaagttctggcaggagttggatgttgcagttttgagtccaaaggcagtctcgaagcagaattccctcctcaggggacttcagtcttttctcttaaggccttcagctgatcagatgaggtccacccacattataatgggtaatctgttttactcaaagtctactggcttaaatgttaatcacatttaaaatataccttcacagcaatatctagactggtgtttgaccaagcaactgggcactatagcctagccaagttgccacacaaaattaaccataaaaactagtatattcaagcaaactgggaggagtatacctatactaaactggcaggagtaacagaaacagacaatctgcaatgtaagttgattaagtgaaggagagtaaggtatttaggtgtggcagctgttgctttaaaaattttttttaatgtattaatatcatggtaaggagtttgattttttttcttttattttttaagtaagttccggggtacatgtgcaggatgtgcaggtttgttacataggtgaacgtgtgccatggtggttttgctgcacctcaacccatcacctaggtattaaaccccgcatgcattagctctttttcctactgctctcccctaaaaattaatttagtttatttaaacaagaaataactgtaaatggaaagtttcccttgatttcatagatattattaaaattaggtattccaagagcccgagactgatgaatcaaagccttccgtagcattgatgagagatgcatcagtgagcaagctagtgtaaaattaacctgagcttcctgctggtgccacagcagggtgcttcagggggaagccagttttcagcacgaatgggctgctgtggaaccctgtttccagttgtcaagacagacttggcatctttttccaacattctagtaacccaaaggaaggaactgagataactactaatggattacttagagcgtaagtcattaaaaacaggacacaaaactgaggtataaaaaggaatatttatcttttaaaaatacaactttgaacactactggcatctcatttacaaagtatttttgtgaaatactctccattggctttgcttgctcagtacattcttttatcttcaattgagactcaagggagggtatgcttgcattattataaataccacaaccaccaccacacacaataaagaccatctctgcctcaggacattcgccccaaacctccatcctctctgtttactttccaccaagcagaagtttctgaatggtccactcacatgctgccattgcgatttgccgatgggcactaccaaggtgtctctggcaattcgcactccaggtggagctgacctatttgtagaaagcctcacaaaccctagctcattatttattcattgattcattactattaatacttatatcaagtctttgcaaacattcagcatgaagtaaacatagtatttacagcagtactcggtttgcaattcaacacactgacaacagaagcaaagggaccaacagactgtaagaaggccagaggggaaagaatattaatataaatcccttctgccactgtgtgcgtgcgtgtgtgtgtttgtgcgtgtgtgcccacacatgagcatattttaattcacagaaaactgaacatgccctcctttaaaagcagactatttacaagtgattctgaatagcatgaacacatgccagtcatactggatacttgctttctgtaaacacatctagatgtactttttacaattctgaaacagatctttaatgtgatatgttagagaaaataactttggaacatttgtcaacttttggttcatagtaattttgcaaaaagccacaaaccatgctttgtcgtttaaaaggtgaacctggtcaggcaccttctagaagacactgatgtgttatttatttactggtctactggggattggaaagacaatggcagttacacagaggacttagtgctgctctcatgcctttcaccagtaacaacattaatgtaaagagaagtttagaaacacaaatcacatacaaatcatcaaaacatttcagttaacagtgtttaaaaaaataccaaggtctacaacagtagtacagacactgaaaacactccaaatactgtttagcatcaggacttttgcaatatttaaagacaaccaattgacagaaaggggaggaagttacagcacttgtggtttgaggcaatttctctttagggcctgtagttcgaggtgctgtcctaggatccttattttaactcaaaagattttccaggaatgaactgacaaattcaaaggaacttccacttgaaaaccattaaaaatataaatcactttctatgcttgtccaacacatatttatcttcaggatcccaagttgttaggcaaagagatttaggtcagcttcaagccctcgaagccacagaatttccatctcttttccaggctggctccaactccagtcatttcctgcttgaaggtatgctggagtctacccatgagacactccacatcgctggtgcagatctgtgggacagagagaacatctccattcaaaaccagttctattttcctaatcttctttcccagtgttgcctactttagaatgctgatgtgtctgtgtgtgtgctgcaggggcgtttaacctcctcctgctccttgcgcatttgtgtgtgttggcagagtggcttccagccagcagcgttcctctgctgtgaccatcagacagggtctgctgagttgctattggaaagagctggggtcagtcatgtggaaacgcctgggtttgtaagaagctgaatgatggctgctcagttctagtgatgctgcgtgcaggtccactgaagctgctgagccttttgggaggggaggaaggtagaaatggctgccaccagagcagaatccctcacaaatgcgttagttcataatggagaagtaacaggaagggggaaatcgctgtgttcatacttctctgcatccccatctctctctctctctctctttcacacacacacacacacacacacacacccctcaatacgaaaacaaaaacaaatctgtggactcctttaggacttgttttaggtggtcatcttcacattagtagagttagtaagttaccctcctcactatgagccttggcaccagggcttgggtaaagagcaccaggggatcctgaaagacacccagagttggtgtcacagtgaatatccctggagctggagggagccccgattctgttggtatcacctcaggctctctttgggagaccctggcactactccggcaggaagttgctaaggcggagctaggcctaggctaggagggcagttatgccttcttcccagtgctggcagtagactgtatccagtcaagtgaatgaagcacattccagggtatcatatagagttgaatccccatttcagaaaacatagataatgtgtatagatatatacatttaatataggtacagcacacttgcaggaaagggtctgaaatatgtgcccaactgttaacagtggttatccttgagcagtgggattgtgcgtggtaacttgcactttactagatttctacactgcttacatttttaagataatgtgcatgtattatttttgtaaattaaaaaataagcagatggtttttactgacacatagttcaatttaataccattgcaatggactacttggtcctagtattcacattccatcctccccttcactgccaaatgggctatttaattgcagaatagcatcacttcccagagggaaatgagggggcagtgctagctagaatgaaagcaaatgccattgaagaggatgtatcaccacagctgggatgtggttagaacaataagattcccaagtgggccactgtctttgttaagagaacatatgcttaaatgacttaacattttggacagcacctatattcaatggcacttctcaaaaggcccagatcctatgaaataggcagtacaatttatgggcacatttcactgaatgctgcttctgaaaaaaaaaatgtatcctgagctgattcattctgaggagtcaagagtcccctcctgcatcttagaggcatccttgatttcctagggaattagcacttacccctgctccagatgccctaggagttcccccaaaggatagcatccagagaaggaaatggaccatgagatcatctgtgagcaaatattcagtctgtgttacagaggctctcagctcattgctccatcttttttttttggcacctgcctcccttgttttgtaatagataatagcaggggtgatggtgggagaggtggatggaataagacttcccattttgaaaatgaacattggataatggctaaaaaccagggacaaaagtttgatggggccgggtacggtggctcatgcctgtaatcccagcactttgggaggccgaggcaggcggcttgcttgagtccaggagttcaaggccagcctgggcaacacggcaaaaccctgtttctataaaaaatacaaaaattagccaggcatggtggcatgcatctgtagtcccagctactcaggaggctgaggtgggaggattacttgagcccaggaggttgaggctacagtgagctgtgatctcacaaatgcactccagcctgggcaacagagtgagaccctgtctcaaaaaaaaaagtttggtgggtaagaaagctgatatgggttggtttgcagcttacaggtaaattaagagaggaaaagtcttctaagatatatgttggaaaaaggatggtcaacttattcaagtttgcctgagactgccctggttttaacatcgaaaatctcaagtcccaggaaacacttcagtctccagcaaaccaggacacatgggtcatcccacttgcaaaggggaagctctgcactgaatcacagtgagagagcaggtgagggaaacttcctgaaagcagtaactaatgacctatttatgcttgaggagagtcaggtcacctgttaacaaaaaatcccacatccccttgcatccccattttaggcccccatataccttattatcaagacggtgcaagtaggaacagatgtattcaatgcttgctccaaatgggtgaacatgaaggaatgtggagataatccctacagagacaagagcatggaggttatacttgagccttgtatttctcgaggttccacatgacagtgaatagcaagagctgactcatatgtacaacagaaatatactggacactattctaagtttacacgtattttactcatttaatctttataataatcccatgaggtgtgtattgtcatccccagttcacagctgaggacacagatgcactaaaagtgtaagcaacttgtccaaggtcacacagctggtaagtggcagggctggtatttgaacccagacagtcacatactgcctcttactgtgctatatcacatgtagaaaagctggcatttgaggagtcactttcattacttgtgatggctaaacactgtctgaattcaaggattttacaatgaatttacactgtgctgggcttttgcagttccttcacagtctttaaattagactttagcctcttaggtgttaataatgccttgctgttgtggtaaaagtaaaaatcatgtactttcctgattaaccttgtgcctctcacaagaaagtctgctgattgtatttgggtattattttgtgaacagctctgtaaagaaaagtcaaacatttcattcacggctaactcaagtggtcactagcattccatgcttagagccttgaatctctttgtgtaacagaattcttatagcagtttacagcctccaggaatgcccctgatttccacttagcctaactctggggtggctggcagcttcacatgctgccttcattgttctggccattaggttaattgtttaatacttctttctctgggaacaggtggaaaataaatttttcaaaagtataatatttctttctttcaatttttttttttttgcgttcacctcctttcataagatcttaagtgcatcaaatagacccagaattgagtttgttgaaaattgtcaggaaataaaagcaaaatttgatttggtttctaaactacaacttgtctgtccctttaagaggctgacaaagactagcacaggtttaaattgtagtttgaagttcaatcaaaggggtaagttggggaagggttccagaaggaactgagggcagggctcaaaatctgttccaaagggatgctattacttagaacattactttattcttaaacgactagataaattgaatttctaaacactgattctggctgagaaacttaaattctgaagaagacattccatgtttgaagaaattctagacgtcttggccaagaaaggctgtcaaatgccaagaaataactccagaggtttaaaaacattaagcgattttgtgggttcacacccaaaaagctgattgaaaaaatagattttcctttctctctgccagcccaagactaccttcttgaaaaaacaaaacaagaaagacttattttaagaatctttttttctaggactatccattcacagaggcttccttgtatccccagcatttctctgacaggtctccctgttgccatgccaatttgttaagaacttggagttggaagacgttaataagttgtaataagttgtcacttttcttgaagattcaatggcaggtccccctgtgcatctttattaacatatcaaagtgttaaatctgaggataatatccattaccaaaggaggcagagatatcttaaaaatatgcagaagccagtcagtgtggagggcttttgagactagagtggggctactgtatagctcagcttcctagatggcagctgggattatctgctgtggcctaagaccagtcactcttaaatgattagcccctcttaaatattttagagcctcaatctgccactgttctccaaatggaatataaagttagccagcatttgtgaatggtgctgtgaagtgtaatatgttttctacttactgagggcttactatgggccaggcactatgctaagtgatttaggtgagttatcgtattaaatactcacaactgccctttcgggtcggtaatatcattatgcccattttgcagatggaggaactgaagctcagagaagaaatggtggggtcaagatgggaagccaggtctgtctgattctttaaccatttgtgccatcttgcctctctgaatgaatttttacagacagcaatgctagcatggacctcatcaaagcccactagtgtccaaaacaccagtttcctgagtcatctgtcactgtgatataataaaaaaattaacatgtggtctttgtccgtggtccccggggcgcacagctcctaaaacctttggaatttctggagtgataagagttaagatgagtggtagctgggggccccttataactttagaattggggctggccatcagaaagacttaggcatgattagagggaggagagagtggctggagattgagctaatcaccaatagccagtgatttcatcagtcatgcctatataatgaagcctccataagaactttgaaatgatggggttcagagaggtttctggttggcaaatacatcaagatgcgcacccaaaaatgtatagaaactctgcataccccttcccagtaccttgctctatacacctcttccattgtatcctttatgctaaatcagtaagagtaagtaaggcactttcctgagttctgtgagccattctagcaaattatcaaacctggggtgggtattgtggaaacccctgactttgtagccaaatcagacagaagtagaggaaacttggatactgtatatttgagactggcatctatacagagggcagtcttccaggactgagcccttaaactcatggagtctaatgttaaactctaactttgggtagtgagtgtgagaacagaattcaactgtaggacacccacttggtattgaagagttggagatgtggtgttggaaaagacaccacgtatctggtgtctggaggttaaaacaaacaaacaaacaaacaaacaaacaaacaatcccttgtcatttggtgtcagaagtgttgtaaaaatagcttagccagtaacctggaaaaacttgagaggcctatagttgctccagaggctctctggaaaagctctctgccaaatacggtctgcgctagccccctgagtggacatgagagggcttatctatccttgcacagatatttaaaaaaaatctacagtgtgtttctccagctgacccctcttagcttagtgcttgtactgacatgcttgactgcttgacatggcagtggctacaaggagtgtgagggaggctggcagctgctgttaaatttggaaatttgtacttgttcttaacctatcatcttcagaactctgagttcttgcgctgccatgcttcataaatgcttggcatgtgcttattaatcttaggtaaagccctcctctcctccattgtacccaggcattgtacgtggcatgtgtgcattagcttccttacccactagcagtgcttcacgttcagatttgataggactgctgttcatggtcttctcaagagggtattcgctatcctggtttgaggcacacagcctagaagcacagctttcctgtggacacaacatgcttctaggtcagttcactttatttggcaatagagttggtttcaattaactacacaacaggtaacttaacacaggaccataaaaacaataccattcaatttggattactgaatgggagagaaaatagcataaattacaaaagcatcacagatattccaaagtttatttatagggctccaaaacacagaaacatttaaacatttaccttcaccagtttttttttttttttttctgccttcatcttgactttatacaagcaatctgggcaactagacccaacatttatggtatactaacaagatgctaggcactgttaggtaagtattatctccattctacagatgaggaaagtgaggctcaggtaaattggctaagatcacactgcaaggaagtggagccaggatttcatcccactgttaaaaggaccattgtttttttaaaaaagtttaaggtccacactctgttaatggtaagtcccatctcaatggacaatctacgttggctacactgccaatccactgatagtgaatcaactgttggtttttgaactaaaaattagagcttatattccactgacagttaatcaactgttggtttttgaaataaaaattagagctttcatttactagtctttctctctctctgatgaggacattatcagttagaatattcctgactttacagcaagaaatgaccatgacaaaaaatagcattagtaatggccttctttgttgtggaaagttcttctctttcagaatgtagcaggaaggggcggggggggggggtggtcctaagagaaactcaggtgaaatccatgaccagcagtcaaactgaaaaatacctccagacctttcatggctctttctttctctctttgggtacggagaatatcttttctgttattataaatgtgaaggcaaagctttcagaagaaggaataaaagaaatcactgcttcttttactgctgaaaagaaaatgctgctgaaatgctccttggggggcagatcatggctgactcagatgcattttcacttcttctctttccacaaacccttagaagggacaggattccttctgttttcttcaaagatgtcttcaaagcttccaggatgctgtctctgaatgaaatgaatggtctatgctgcaagacatgttgttgtgtgaatttacaggcttcctggctgtagtcagaggggaaccctttcttgatgacctactcaatctttggcctttagaatccaatccaggcagtaaccattatgccaagtttgatttaaactactagctcacttctaagccatgggcttcacatctgcttctgacccccttaaaacattaaatgatacggtaagccgtttcttaagtgtgagagtttaacagattggggttgatttaagatgtgaaaatattctgggaagttttagccatcttgaatagaactgcagccttccttaaacctgacttcaattttattatagctggcatttaaaaaattagaaggtacattgaaaggatgcttatcaccttgaattttactagcagatttaaagagcttagttctttccgcactaagacagacataagtcacactgttatactgcaaaacactgacaataactcaccctgtagcttactgtcaagaaacccaaacaaaagcaaataaaaaaagagatccctcctcaccaaaacttattgctttcctttcaacctgaaattatttttgcagtctaatgtgatggtactttgcttcctaacctaattgtgtcaggttgaaatatttggtcacaaatcagcttcccagagaagatcagtttataatgaactgtcatgaatttctctaaaagaagctttgcttaaaataacaagaaaaaaacatattttgactcactgttttttggattatcagttggatcttttcccctgtcctcatcagccaacacttcatggtctattcagtttccaaatgggaaacacttgcccttaggcacaatatggcaagtttcttctatgccatttgacctcttacttctttaaatgaaatactttacaaagcagaaagctacttacacaaaaaaatgtccttaggtcaaattgtgatgtcaatcctgaagagtaattctaagcataatgtcatgagcataaccccatgtctgtctacagtcttctggatacataatccattttatgcaggaagcaaaacagagctatgtggcagctctgggacactttagaagccccgatggcatgaggaaagtcctgataagtaaagcagctttggctcttttcaattaaatgcttgataaatgaatttctctgggattatgcttgtttctttaatagtgcccacaaaactggaaagtgagttggttttatgaagtggaagaattaaaagcacgttgcaaatggcctctagaagaaaacactttcaatcatttgtttcaactacaccaaggttgccagttcttaatgacactctaggggaaggcactgtgctggtaaacacactcagggcctgtatgcactgcatcttcctgagctgagaacagaagataaagagaatatgctcttgaggaactgtatcactgttgatttctgaccctcggtccaagctcctaatcttctcttcctttagagaattaaaacaaggaagttttggtgaatgggcttcccttttcagaggataacatcagctgagtattgatgcatcaaggaaattggagaggttgactttacacaccttgaatagaatgggcacctgattcatggttgtgatacatgattctatccagatattagactctctggtcctcattggtggttcttattgctgagagctctcaattgataaagtcccatcttggcttctagctttagaatactgtgtctcattttttttccccaaggtttctctcttcttggtattggctattcctctcatctgcagctgctcattattacactaaattgactagctgcaaagaaatgccaatgtgctagctgcacttgtgtttcttcctttaatgaaatgctcaattaaaggtgctttgtgtcacatgagttttctatgttgctatttgcttgacaagatgaagcagggaagaggtgtgcactctggtcgtctccaagagagaagactgaggagttttagggatgaaccgacttcttattcattgaaaggtgtacactccagaacccttagaaatgccaaggactcacacctaaaagcaaagcccttagtataagaattacccccgagaggggcttttaattcccaatcggccaaaaatgtttggccccattgatttctagggcataacttccagggcattttcactgtcactgaaaagtaggtaaaggggcaaggaaaaaggttcacttagggtgcatgtaccttttctttaagattttccaacattttttccacctgtaacttgtcatctttgagtttttcaagttcagcttctttctttttgtattcctcttggactttgagtagatgctacaagaaaagaccaaagacaatcaatttatgaattacggagccacacttcatttaaaatctctggctgaaatcagatatcaggtgggcctgcctcactttcctccagcacacacgaccatttttccataaagagattgggcaaatcaagatattttcactttacgttattttgtctgcctcttacgaaattcctttgaacttgttaatattttagaaaggtcctgagaaactaattgatccagtcacttaacttcttccctattctggccaggggtcagagtaggatgcagttaatactgtgtgggcaatgttttgattgctgcatataagtaaatgtaatgttgtaaagcattcttgcaaatagccatttgccaagccaagttcaatttctgtgaggatagtagtaaataatccaaattttacatgttagtttccatataagtaggcaggaagctatatttagcattattaataatttcaacaaataatatttattgagtgcctaatatgtactaagcattgtgctaaaggtgttacatgcacggtctcatttaaacctcacaatgaccctatgttactattatccctaaggctaggagaggttaagtggcttccctaacgccattcagatagtcagtggcagagctgggatttaaaaccaggttgggtcaaccccagagttcatgtccttacatgccttattatactatacgtcttttgagataagatgtgagaaattttatcattgtttacaaggcatttttttcaatacaaaataatcaaaatgagtgaaattattttttaagacgtagagacctaattctcactgaggtctttgaagtgatgaaatgaaataaaatttcatgattttcgaattgcatttaagtagcagaactatccttatgtgaaatggtttgaaaatcaaagaggggaaaaacagcaacaacaaaaatgtttccaaagtcttgcttttcagaggcttgcaaaagaccactggaagggttaaaaagcatgatacaatgtacattgtcaaagttctttgaagtgtaggtgaggaggtgcattttttcatagaaagatctctgatataatttacatgttctaattaaactccatggtgacggtaaaaggaaggtgagcattacttcacacattttgttaacagaaaaggtgaaatattaatgtcatattacttgtcgtataggaagacaatagtggcagaaagaataacatagggttcctagtgccagaatagactgctgttcatgatttgtaatttccaaccagcaattagctttgccctagacaatttcaaggcatacagttaaaaactattgcacaatttaagatgtaaggacaatggctggtagtctagcatgacagaagacaatagtggccttactcagaggcactactcctttactatagtgaaagcagctgttgatatcttttaaactgtaggatcactgtggtgatggttacgtaaaactcctagatgttgaacatctgctacactatgttgtctgtgaatgcaatcgcagttgggtgcatttatttactttgctttttacactttgaattatgcacaggtaaactcattcacataagtgactgttaatacaaaacaaaataaaaacaagttggtattatgtgctcaaagcattgacacttaaaaacctataatgtacctatttctactgaaatcaagggtcgattcctgccattccttttaaaaggctgtatttcttggtattctatcaactagatacttgttcatcagctctttttcatatctaaataattgaggttctttgtaaagaccctgaggccctgtctagatccctaagtaccttctgaagcataaagaaaagattagattatgttcagtgtagtctaatgttaaatatttttcactgaatgctcattctttgaaagttggcaatccattgctatctctgtattaattggaatatttaattaaacacaacaataactccttcctcagccatgccagataatattacatcaagaagaataataggtttgatattcaatttgattgcaggggacccttttataggtgagaagctgatgctattctacccagaagctcagaaaaccaaaatgcctttacctgttgcattccttgcagggcttgttgcaggagtttcagctgctgttctttgttagggtcatcttctctgtggactttgccttgttcttgcttgagcagttctacttcattccggtaggcatcgagctgccaacggaggctgtcattttcttccttcagagcttctgcctgtgatactaaggctaacaatcaatataaaatatgaaaccatatatccagattcatttgtgattcatctggatatcacaaaaaggttggttcttcctcttgatgaagaacttcaggtttgagttggccatctcagcaagagatagatacaaaagcacacaggcctgtttttataaatgaactaggattccaacacacaaaagtttacatcatgttcctcattctccacctcaaatataactaagatatttcgaggtagcatcaattttttttatttgaaatgtaggaaataacagccctataataataatataggaccaattcccttgaactgacaactgcctacacaatcatgttgctgacagatgtttttaaggaatgcagcattgagaaacttaacctcggaatttcctgctgctctgtagctttgtataaagagtcagattctaacttcagttacactcattttatttttactgaaaatgtaagggggaataatgaagaatcaaaagtagtgccagaggttagcaggctggaaagcaaatgctgagggacatggttatgggaggcacacaaatatgggggcccggaaaaagaaatacaaggcacagatggagttgtgttagtgaatatgcaatcgcatttcaagatttctttctttccttccttccttttttttttttcttttttttgacagagtttcactctgtcgcctaggctggagtgcagtggtaggatcttggctcactgcaacctccgcctcctgggttcaagcaattctcccgcctcagcctcctgagtagccgggactacaggcggccacaccatgcccggctaatttttgtattttcagtagaggcggggttttgccatattggccaggctggtctcgaactcctgaccttgtgatccgcctgcctcagcctcccaaaatgctgagattacaggcgtgagccaccacgcctggcccaagatttcttaatatgcacgttttcatgtacttcttttaaaataactgttaaacaacaatttgaaacacacacacacacacacacacacacacacacacacacacgaatatagcattgactcgtctcacagaggaaaagtaaatgtaaaaactaagacataagatttccagtttccagtctggcatgtaaggacctttagaagctgccactctgtcttaataacaagtaaaaagctgaacaatgtgaaaaatcaacaactctttttatatttgttagagaagtgaggttacagggcaaacagctgcccccaaaacaaaactggagatacagacaggtgaatacagagaatcacaatttactggaccaaagacccatgagcagaaacttccatgggacccagtccttgggtaggaaaacctgaggtgtaattaacaaattgctggaggctcagtgtggacaagtctgtgaaattagctgggcgtggtgttgtgtgcctgtaatcccagctactcaggaggctgaggcaggagaatcgcttgaacctgggaggtggaggttgcagtgagctgagatcacgccactacactccagcctgagtgacagagtgagactcagtcttggaaaaaacaaacaaacaaacaaacaaaactccaggaagacccagtcattggagagctcccacacatttgtaagttttagctccaggagatataccagttccttacagtgaatatcagagaaaaatctcctcatgtttctggcaggggaaggggaaaaggaacaattttgaaattgcagaccatcctggtcttcttcacaaggcctgccctcgggaaaatctattttaccagagcctcacctgctggggttttagaagaacctaacagacctgggggaagataaatgtccaactccagccccctcagccatcctgtcccaccaaaggtgtgtgtgtgtgtgggtggggggtgatggtggtgggagtgggataaaactgagaagcactggtgaagttcacagttcagagacacaggttcaccaaaagactgagacctaatcatagaactagagaatgctttcccttcctctacaccttaccacaatattactaaagggctacttatgagaatttctttcacctagtacatcatgtccagattttaatgaaaaattacaaggcatactaaacagtagaaaacacagttttaagagatacagcaaacaccagaaccagactcagatatggaagagatgttggaattatcagactgggatttttttttaaaaaactatgattaatatgcaatggtctttaaagaaaaaattagacaacatacaagaacagatggataataagagcataaagaagaaattcaaagaaagaataaaattaaatattagagatcaaaaacactaatagaaatgaagaatgcctttgatggggaaattattagactggacataactaaggaaataatccctgagcttgaggatatgacaatagaaacttccaaaactgaaaacctgtcttagtccgttttaactgctataaccaaataccacaaactgggtagcttatgaacaacagtaatttatttctcacaattctggaagctcagaggtccaagatcaaggtgccagtatcttcagtgtctagtgagggcctatttcctagttcatagatggtaacttctacctgtgtcctcacattaggaagggacaagcggctctttggggtctctttttataagtgtactaatcccattcatgaaggctctgcccttatgacctaatcacccccaagggcctcaccccctaatagcacattgctgattaagtttcaacatgaattttggaggatacatacattcagaccatagcaaaaacaaaaagaaaaaaacaacagatgctggcgaggttgtggagaaaaaggaacgcttttacactgttggtgggagtgtaaattacttcaacaactgtggaagacagtgtggtgaatcctcaaagacctagatccagcaatcccattactgggtatatacccaaaggaatataaatcattgtattataaagacacatgcatgagtatgttcactgcagcactattcacaatagcaaagacatggaatcaacccaaatgcccctcaatgatagactggataaagaaaatgtggtacatatacaccacagaatactatgcagctatttaaaggaatgaggacatgtcctttgcagggacatggatggagctggaagtcattatccttagcaaactaacacaggaacagaaaaccaaatactacatgttctcacttataagtgggagctgaatgatgagaacacatggacacatgggagggaacaacacacgctggggcttgttggagggtagggactgggaggagggagagcatcaggaaaaacagctaatgcacactgggcttactacctaggtgatggggtgatctgtgcagcaaaccacaatggcacgcatttagctatgtgacaaacctgcagatcctgcacatatacccctgaactttaaataaaagttgaaaataaaaaaaatactgaaaaaagtacataacagaatatccaagaactgtaggaccactacaaaagttggaaacatgtgtaatgggaatacctggaaggagaagaaagaaagaaacagaagcaatatttgaagcaataatgactgagaatttctccgaaattaatgtcagacaccaaaccatagatccaggaagttcagagaacacgagacaggataaatgccaaaaaccccttcagcctacgcatatcatattcaaacttaagaaaatcaaagaaaaaatcttgaaagaaaccacaagggaaacaaacaccttacctatagaggagcacaaataaacattatatccgacttcttttcagaaattgtgcaaataaaaagtggaataaaatatttacggagttaagagaaaaaaaatcaacaacctagaattctgcaccctgtgaaatctggatctacataaagaaaggaagagcatcaaagaatgaaaaagtgaatgtaaaataaaaacttttggctgggcgcagtggctcatgcctgtaatcccagcactttgggaggctgaggtgggcagatcatgaggtcaggagttcgagaccagcctggccaacatggtgaaaccccgtctctactaaaaatacaaaaattagctgggcgttgtggcaggtgcctgtaatcccagctactcaggaggctgaggcaggataatcgtttgaatctgggaggtggaggttgcagtgagctgagattgtgccattgcactccatcctgggcaacaagagtgaaactccatctccaaaaaaaaaaaaaaaaaaaaaaagagagaattatgctaaatctactcttcctgtgctttagaaacggaacaacaaagtctgggtgacagcacatctgtttacagtatggtttaccaaatatcttaggcccactgttgagacctactactcagaaaagaatattcctttcaaaatattactgctgttgacaatgcacctagtcacccaagaatattgatggagaagtacaaggagacaaatgttgtcttcacacctattaacacaacatccataccgtagcctgtggatcaagaagtcattctgactttcaagtcttattattttaaaaaatcatttcataaggctatagttgccatagatagtggttcctctgatggatctgtgtaaagtagattggaaaccttctggaaaggattcatgatgccattaagaatgttcatgattctggggaggaggtcaaagtatcaacattaacaggagtttgggagttgacttcaattctcactgatgaatttcaggagttcaagacttcagtggaggaagtaatggcagatgtggagggaatagcaagacatctagaattagaagtggagcctaaagatatggattgaattgctggagcctcctgataaaagtttaatgaacaaggagttgcttcctatggatgagcaaagaaaatggtttcttgagatggaatctattcctgatgaagatgctgtgaacattgttgaaatgacaaaaaaggatttagaatatttcataaattcagttgataaagcagttatggggtttgagaggactgacttcgattttgaaaaaagttctactgtgggtaaaatgctatcaaacagcattacatactacagataaatctttaatgaaaagaagagtcaattgatatagtatacattattgtcttacttgaagaaattgccacagtcacatcaaccttcagcaacctccaacctgatcagtcagaagccatccacataaaggcaaaattctcccccagcaaaaaagattacaacttgctgaaggctcagatgatagttaacacattttttttagcaatacagtcttttaaaattaaggtatgtaaattgttttttaggcatttgcttaaaagactacagtataatgtagacttaacttttatatgaactgggaaaccaaataattcatatagagtgctttattgcaatattagctttattgcagcggtctgaaatggaacctgtaatatctgtgaggtgaggtgaggtattcctgtatgcatttatgtatgcttatggacaagttaaataaatgacagcaatgatacaagaaatggaaggggagaatcaggagcattttgctattataagatacttgcagtacccatgaaatggtatagtgttatttgaaagtggggttgaattaattgtaaatgtatataatctagggaaaccattaaaaaatgtgaaaaaaagtataaatgatatgataaaggagaaaaatgtggaataatataatatgttcaattaaaaatacaaaaggcagaacaatggagaagacaaaagaaacaaaaaacaagggtaaccaaaagaaaacagcaacaaacatggtagatatttatccaactatatcaataatcagttaaaaaattattgatctaagtatgccaattaaaagacagatgtcagtgtggattaaaaaataagacccaaccataggttgcctacaagaaatctgctttaaatataagggtgcatatagataaaaaggaaaaagatggagaaagatataccattttaacactaattaaaagaaagtggaagtggctatattaatttcagacagagctgatttcagagcaatgaaatttatcagggagtaagaggagcattgcatactattgaaggggttaatactccaagaagacataccaatactgtttgtgagcctaataacagagcattagaatacacaagtgaataactgatacgactgcaaggagaaatacatgaatctactattacagttggagagtttagctcccttctatcagaaatggacagatccagcaaacagaaatcagtaatgacacagttgaactcaacaccaccatcaaaccactgtatataattaccatgtatagactatttcatctaataaaagcagattacacattcttctcaagctcacatggaagtttaaccaagagagaccacattatgggccataaagcacaccttaaaaagtaaaagaagagaaattttacaatgtatgttctcagatcacagtggaactaaattagaaatcagtaacagaaagatagctggaaattccccaaatacatggaacttgaatagtatacttataagtaacacatagattaaaaaagaaatctcaagaaaaatttacaagtattttaaaataaatgaaaatgaaaatacaaattattaaaatttgtgaaatgcagtgaaagcagtacttacgtgggcaatttatagcatttaatccatctattagacataaagaaagttctaacactaataatctaagcttttaccttaggaaactaaaacaagaagaacaaattaaacaaatccaaagtaagcagacattttgtcagtttcttacaaaactaaacatactcttaccataccatccagcaatcatgctccttagcatttatccaaatgaactaaaaacttgtgtccacacaaaaatctgcacatggatgtttacagcagctttattcataattgctaaaagttggaagcaatcaagatgtccttcagtaagtgaatggataaataaactatggtacatccagacaatggaatattattcagtgctaaaaagaaatgagccatcaagccatgaaaagacatgaaagaaaattaaatgcatattactaagtgaaaaaagccaatctgaaaaggctacatactataggattacaactatataatattctggaaaagacaaaactttttactggagatagtaaaaagattagtcattgccagtgattagtgaggaggaagggatgaaaaggtggaccacagaggattttagggcagtgaaactattctgtatgatattacagtgatggatacataccattttaaatttttcaaaacccaaagaacatgcaagaccaagaatgaaccctaatgtaaactataaactttaggtaatgatgatatgttaatgtaggttcatcaatagtaacaaattataatcaattgtaacaaaatgtaccattttggtgaaggatgttgatagtgggggatactgtgcttttatagggacagagattatacggaaactctcaactttccgtacaattttgctgtgaatgtaaactgctctaaaaaagaaacttattaatttaaaaaatgaaggaaacttaggttatatgtaattatttatggtttaggtcacatttttcaagttcaaaaatcataaagcctatttcaaaatatttaatcagaagatttcattcactcaacaaacattcatttagtacctttagaatgaaaggtagaatgaagtggaaagcaaaaaattgtgtaagggtagacataaattagataaaaaggcaaggcttttattttgagccgtctcctcaaccttatttttaatgagaaccaaataattatggtgggttttccataggtattaaagaggtcaataacactagtttcaatgtagtccaggaaatacaatttagaaaatcaagtttcaggcttatgactatggtttaaaaaatatgatcccactagtttctattgtttacatgccaaattaatggaaacatttgtagtttataccttttttgattactaacagaacacaaaacccagaaaaagagacatttttaaaatggatcaaagcagactgggccgcaggccatggggcccgcgcccgcctggagggatggggctgcccagcacctaagggctgggcctgctgcgtttcatgccccagcagccgcgccccacatccacgctgggatggtgaacctagcagccatggtgtggcgccggcttctgcggaagaggtgggttctcgtcctggtctttgggctgtcgcttgtctacttcctcagcaccacctccaggcaggaggagagggcagtgagagagaggaatcccctgcaggttcaagaccatgatcagcccatcccgtggaaagtgtagtttaacttgggcaatagcagtcgtcccagcaatcagtgccacaactccattcaagggaaacacctcatcacggatgaactcagctacgtttgtgagaggaaggatttgctggtgaatggctgctgtaacgtcaacgtccctagcacaaagcagtactgctgcgatggctgctggccaaatggctgctgagtactgtgtctcctgctgcctgcagcccagcaagcaacttctcctggagcacttcctcaatcaagcagctgtggcattccagaacctctccatggcagtcaaagatcacttggaattgtgcctggtcaaatgcaggacctcatcccagagactgcagcatgagaacacctactgggaccccatagcaaagtactcctactgagaaagcctgccagagctcttccctgcatgacaggccagtggacttactccagcctgggtgaggaggccccactgaagaactcccctcctggggcccagcttcagcactcaggccaggccgtgggaagaagacaaaggcagcgttaggaaaccttggctttgaccacttcttgtgttgtcatctttggcttcattcacgacctgggcttaccagatagaactcttctgtaaagcagcttggaccctccagctggtcccatttgggaaagatgaaaccgcaggccaggctcatggcagtgttggcgttcttgcatgactccaccctgagacctgcacagggacctgtgacttgtgttcgttggggactggtgtcacttctaggtttgatccagggcttttcactgtaaaattatttattggattcctttggagtagtgggaaaattataatgttttatgtaggaaaatgccttgcccttctagttgaatatgttcaaggaaattatttttgttgttgttctgtgttttcaagtttcacgagttaagtcatcccttcacccagataaaatgttttgtcttttaggacatggatgttctctctaggcagttatttttgtttgtatttcgacagtatcaagcgtaggccctgaacataacctgttagccatatcctgatgtctaaaattatctaaaaactcagacactcttccattctaatctaactgcaagatttctagcagtgggcactgtgtgtcctccctcagtttcttttctagtgacagttgaatgtgctcatataccctatggagagcactgttttagtagaaatctaacttctcatcctggagaaattttcttttgccacttaaaattaactgtgggctgctaagccagggtacaatgggagcctcaggaagatcagaggcaacttcttctgttctgtcaatagaaacccaatgttgaggcaattcctaaacagagatgtacctaacagcttgctgtatgtgttcattctttattgctttcagctttgggggcgcaataggtataaatgtttagtttccctattatttgcaaggaagaagaagaaacccaacttattagagtgctgcaagagaagagtcttactcctaccctgagtgggagatgagaatggtcattatggcttagagaatgctgcatgtgtaggttgctggtgtgccctgaatccacgtgcataaagcactccccatttttctactgtaatgcagattctctgattcaaggtctagcatatttgatcctaagatcaagacatcattccctttgaatagtactgctctttgatttcagtagtcacattaacacaactctcctatattccttcactaacctcaggattgagcaaggtcttttttatttatttttttttgttgaaattattgacctgggagcagggtgctagttctatggtcagaattcaatattttttttttcagtggagctttttctttgggcatatttgtcttccaatacatttctgcaatatttccttaacttcctactactacctcttatactcatctcccaaaataatttgcctcccttaaataagttttcttagatggtaagttgtcaggcaattttaaaaatattagatctcaagaaatctattccatttgcattaaacatttcagattctgtgtgtttgcagcaggactaaatcaaactctgacgtgaaaaaataaaaataaaaaaatggatcaaatttacaatctgtatattaaatgtataagaaagttaaaaggcaatttgacaaagatatgaattttcttgattacctatagggaagaactttgggtaggagaaagtaaaagaaaagtgatagaaattaaactggctgggtgcagtggctcacacctgtaatcccagcactttgggaggcctgaggttgggagtttgagaccagcctgaccaacatagagaaacctgtctctactaaaaatacaaaattagccgggtatggtggtgcatgcctgtaatcccagctactcgggaggctgaggcaggagaatcccttgaacccaggaggcagaggttgtggtgagctgagatggcaccattgcactccagcctgggcaacaagagcgaaactccgtctccaaaaaaaaaaagaaggaattaaacaattaaaattattagctataaatggtgaaagaaggttttatctaaaggaatttcaaagagaagactcatcctctacataatgaatggaaagaacttgtgcattaccaagatgaaatattgctgtggtttggttatgatttatttttcttcagcaaaatgcatattgaaattttatccctaatgtggtggtgttgggcctagtgggaggtgtttgggtcataagggtggatccctcatgaatagattaatgccctccctgggaaggggggtgcattctcactctattagttgttaaaaagagcctggccgggcttggtggctcatgcttgtgatcccagcactttgggaggccgaggctggtgggtcacgaggtcaggagattgagaccattctggccaacatgaaaccccgtctctactaaaaatacaaaaattagctgggtgtggtggcatgtgcctgtaatcccagctactcgggaggctgaggcaggagaatcacttgaaccagggagtcagaggttgcagtgagccaagatcgcgccacagcacaccagcctggtgacagtgggagactccatatcaaaaaaaaaaaaaaaaaaaaaaaaaaaaaaaaaagcctgacacctcccctctcctcttgcttcctctctcaccatatgatctctgcctacactggctccccttcaccttctgccatgagtggaagcagcttgaggctcttaccagatgcaaatactcaatcttgaattttccagccttcggaattgtaagtcaaataaaccttttttctttataaattacttagtcttaggtattcctttatagcaacataaaatggactaagacaagtatatacaaaaaaaaaaaaaatccacattagcgtgaaaacattctgtactcctaaaaggaagctgcctttagagaggtgctgggtttaattcaactccttgaacatgggggttttcctaaaactagtatgtactgatgtaggctgctgtggtcagatggtctatccaaagcagaaagtggcaacgtaatatgaagggttctggttagaagtatcttctactagtgttgttgaggtgttcttagcatccacatttgttttctgcggatggccatgcaatgatcctgatacagcagttttaaaacttgcattttagttttaaagacttataaaaagatctttggcatgacatattcattttatgattggttttattattaattttaattcttgttgttatgcagattttgtgtctcttggattccaagcactccaaataatatctatccttgccatctcttccagtggctgggatacttttcatcagacaagcactaacaaccacaacatcaaaagaagatactatgagtgaagatgatttttatatacaaaactctatagaaaaaggcatattaactatctgccaaacagaggaagaaatatttggtttgcttgcagggtgagtaccaaggacagcatcttgagctggagtttggctgaatagtacacaggttactctgtaaatcaagtgactcctacagattaacaattattaatttctgttttggtttgcatgtttgtcctctggcagtccacatggctcaatacaaaatagtgatatttcattttcctccttttatttcttcttgtactgcaggccagtaattatgctcatgttctacatgtcacacggagatacatggaagagaaaagggcagagatctaggagaatgattagaggcgtattctccagtttaaatgtaaaaatattttccctctgagaaaatgaggaggagagactgtttttgtcctgggggaaagggcatgctgatgagcagtgatggatacctgcagcaaagtgggagcagataataatcttctcagtttggacctgtcaccaagtgaaagaatgtgatcacctgtaatgctactgaggggaccttacctacaaaatatatttcccactctctgaaatgaggggtttttgtcattttaatgaggacaccaagtctttcctttcacagacttaatattaattgggcccatttctgaagctgaagttctttgtacattgccagaacattgaaaagttcaatattaccttttaataatatgtttgagtaggtgaatccatcagtcctgatactaaagagcatagtacagtgaatgtattcatatcctgccatcattagttcttggcttctcctttttggctatttcctatgtggggaaaatgtttctctttatgacaattgttcctcagatctgaaggctgccagttcatcatggcaatatgaaagtatgaaggcagctgtgaactcctctttttagcggagccactaacagcaaaatcccagacatgtttctgtacaacaaaagatcaaaaatgattttgtgccattaaaaaattagtgcctgagtctcttcaatggtacaaagaaaacaagaaaaaaaaattagtagaagtaaattcagggagtcagccacccttttaaagcttaattacaggagatgctaaaaatgttacaaaattatggaaggaagaatgggtaacatttctctcaaggctaataagaaagtttgagctgaggtgattcacaaagggaaaaagctaaaaagaacaaagagtgggaagaaagagcaggaaatgatatgaataagacctattggggtggctgcaggtcagctcaggcaaaaaatctcaagtgggtttcctgacctcacaatgccttgctttcccttgcctctacaggttattgtcaccattccaaccaggcttctgtcagcatggatgcacctggaacctcattgttacccctcttacatctctaaattcccatctcaaacacagaatcctcatctaccattttcctcactgcctctcatcaccccaagactgctctctttccttgctgggatctttaatctcacggagtggccaagttcactaagctagttcattagctgctttctggctgaatagatcccagtgcaacctcctcagtgccttgtattgcttcagcttcctgaaaacctctggccaggcttaccatgccaatccccaactcacagtcacttgactccactctctcttatcctgggccacagagaactcttataggaagttgcagagctaggcagctacatcaatacacactcatgttggcccttgctgatgggtctctcacctctcactgatttcttccttccatactgcccatagcatttattccaaatcggttcccttctcctcgtggtctcatttccaaatcatttttgtgatgaataaacaatctcttagtatatggagaagcctgggctacctatattctttcagcttcccctctcttgtctcagagaaagagggctctctcctctctaaagtaaacgctacttgaatatggatcccttccctttcttctttcaaagattccacttccatagtattcttttattttctagcatcttcaatctcatactctccattgcctccttcctttttattgaacaacaacaacaacaacaaaaacccttaactttatcgattctagttgccatttataatatccatatttccttttgcttagtacccaacttcttgatctatggtctttgtttactttattttactaatgtcatgtattctggcccctacctctatcactctactaaaatagctcttgcccagcattgtttctctcaattccgattttctttgtaacatctgttaatgtcaatgactacttacttctataaaaacttttcttggtttccacaacccaattcgtttctagttttcttccagcctctcagaactgcttttttctaactcctctgcaaactcctctttctttccttctcccttattgtggatagtcccccaaattctgtatccaaccttttgctcttctttcacttgtctttcatattcatttaataattttctcagggcttcagccgatacctctacactaccatctactattccttctagtttcttcaactctaatttgaatacaaaccccttctgcccatttctcaatgatctactatctgcagttcatctcatcatattccgcaaatcagtcccatccatcagtccatttctgtcagttctactgttatggtttgaattgtgtcctctcaaaaaagatatgttgaagctctcagaatctggcttatttggaaacaggttctttacgaggtagtcaaattacaatgaggtcattatgatgggtcctaacttgatatgattggtatccttattgacagaggaaatttggacatagaaacaggcatgcacacagggagaacaccatgtaaacatgaagacagagattgggatgatgcatctaccagacaaggaacatcaaagattgctggaaaatgaccagaaactaggagacaggaatgcaatagattctccctcacaaggaactaaccctactgaaatcttgatctcagacttctagcttccagaactgtgagacaatacatttccgtcatttaagccacccactttgtggtactttgttatgacatctctagtgaaccaatacaatcaacaggtctccagtctctcagactagaaaacacagactcattcctggctttttccttttcttaatcatctgtatccaatctggcactaaagacttaggtatattcctcgaaaatgactcctagcatctttaatctcattcaatccattgcctccttttcttctaccatttttgtctcagttcctcttgccttcactccggtcccacccttcagcattttacatctcacttcctgtaaaagtatctggttagactctcttaattgaagattatcttttaaaatgtataattcatgttgctttcatcatattagcgccacagacaagatgtgcttatagtggcatattgcttactatgcgaaatctaaggttggcatacatagccctccataatttggacccatctactctactcagtcttttgtcccctatatacatcatgcttatttcccactttgagccccgacccttttactccctcccttccccccaccatcaagatgctttcttatcttcctatcatctaaatctgttcatctttcaaggccctgatcaatttttcactgactgtgacaactctggcccacacctgatatctcttgccctgctgcattctaatcagtaccttccatgttagcagcaagtggtatttctaaaattttgtgtggatttacacatatttatatctctatctccatcagcttataggacatagtgcttgttaattaattggccaaactcttgaagtggaaataatggaaaataagaggtggggaaggaagaaggagattagattaatattaagggaacagaaaactttggccagaacaatgaaggagaattagtctaagtccatgttttccaaatgtgcttcctggaccaccagcatcgaaatcatttaggatggctgataaaatgcagattcctcagccctattacagacctattggatcagattctgcagcttagacatctgaatttgtaaaggtaacccaaatgattcttcagtataccaagtctgagaaccactagtctaagtaaacagagcagaagatgggtgctgaaagggaagagcttttcttatgtttactgggtacagtactttccatcatggctaacaagataatgaaataattttacactatcatgatttgctttgatgtgattgtccctcttcaatagattgctttgtgtacatcagtcctttcttccatggcaagagtatttaaagtactgcatcacaaatatgggctggctaatatagagtctctcaaataacagaaattttgtggcactccaaggaaagataactgagacttctaggctggttttactttcttcaggaagtaaaatctaaccagaaacataccataggttcctacaattcaagtttggtagcatggacagagggaaaaaaaaaaaacaacaacaacaactctgagatctcgttgcttaagcttttaattggaaccaaatgatagctaaaacatgtagccactttagataaaaactgaagaccttttcactggctcacaatgagcgggatttctgcagttgagtactacagaagtgagataacagaattagatacaatcgaggggaagaaaaatgcacagaagtccttgaattaaaatgaattgaaaccttctgggagaaaagctatttggtaagctccattaagtctattgtagatagctttatttgccaaagcagcatcctggcatgtggaacaggaaagaaaatagctataagatgatctgtcagggagtttccagtctctaaacgaataagattctgtgcagtagccaatacagcttttaactcaaaagagacacagaagcaaaatgcaattatataactctagtaagtgcattcaatctgagtctcccatatacccctctcctcctccaataactccacaaactcagcaatttatcaagtggatgcttaaacttatggcagcatttatttcatggtaacactgactaaatactgtgtacaatactgtagatactgaggtgtaaacaatcatacaagtgaaagattaatcagctataaaacatcctagctaagcacttaaataatttgaatagttcaattcttattcaactctgtgtttattttggctataagtttacagtatttatttgcagtaattagttgactatcctgaaaatgctagctaaccactgattacaaagggtttattcaatatagatagcagtttgtatgtttagggttcaaacatatggcaaaaatagaaaaaattcagatgtaatagctaataaatatctttttcaaagtctgacttgatgtttttctttccttcagagtttctgttcatggagtgaaaattctaagaccactcaagtggctatagagctgctgacttcactatacaagcactggaaccaggaaattcagatttgaattacaatctctctctctctgtctcttttacacacacacacgcacacacacgtacacacacacagcaggaacagtatacaactatatctccaatctctagtatagtgcttagcatgtaatagttattaaataaatgaactcatttaaccatcacaaaatccctgttagatgtttttttgtttgtttgttttgaggcagagttttggtcttgttgcccaggctggagtgcaatggtgcgacctctgctcactgcaatgtctgcctcccaggttcaagggattcttctgcctcagcctcccgagtagctgggataacaggcatgcactaccacacccagctaattttttgtatttttagtagcgatggggtttcgccattttggtcaggctggtctcgaactcctgacctcaggtgatccccacccacctcggcctcccaaagtgctgagattacaggcgtgagccacagcgcctggctgttaaatggtttttataatgtactccttacaagtgtggaagctgaggctcagtggggaagaagtccctcctaggtcaagaaggacagagttcggactagaactcaggtgtttcaactttaggtccagtggcttttccactgtaccttcctgtaatctgactcctaagattgtctggaatggtttgcctaaaaagagtagtcttctggatattttattatctgcaatggtaattctcccatccaagatagtttattatgaaattgaagaggagggtattatctgttgttcaaaaagtttgccctatgggtcccactaaggacctgtaacacggcctctgtctcagagtgaggttctgactatactaggttacagctgcttaaatgcccagcgctttttggaaaagaaagtccacttttaattaggcacttcaatgcaaggtatggataagtgaaaaccacagaaaatcctgtagccacagagctgataatcagccagtatgtacacatatggccttgccacttatttctagctggtatccaggctgataggttgatggccataccttactgggtattaaaagtttgaaaatatcatgtctgcaagtacatgtttattaaataaagaaaacagaattatctttacctgattcctcagtttcttttgtttctgtcatttcttctatttcatcatcagacatttccatttcttcttctcgcctgattcccattaattcatcattatgaatgttgcgaatttcctaaggttaaaaagtatgctttttaggtgggaattccttgaaaatgttgaggaaatgaatggagttaaggataagataaagcagcatttttttttgacatattaggaaaaaaatcctccaaatactcttaaggcaaagaggcatgttgaaagtaaaacagtctcagacaaagcagacttggttatactctgtcttgcattaggctttctttccagacccagagctccaggagtctatgattcttatattcctatcatattagacagtatttttggccatgaaagacattttacctcttacatggatttgtggactttcccttaagggttctgccattttcacctccccacgttggaccctttaattttgctgcttgccattctcttctctgtctttttatagttttactcaacataactcttaattgagtttttgtagttttagaagttacagcaaagatgagctttcaggagtaatattctaccagaccaaccttcccatggataataactataatctttggacaaaacacaaaacaaaacccattaactacttgatgacattggagagtgaacaaaagcagacatattctgaagagaagctgacacttggaagaaaggaatagcatagggtgagtctctcagtttttaaagggcaatttagtctgaggtagaccagagttagcacctcataagatggctaaatttctaatagaaagcccatagtctttatggcctaaagaactcaaggagagttcacggcagttacagccactggaaagtaagaagggaatcccagaaaggagacaatagaggcagggggaaagaactttaaattctgtatataagatctgctcaaatgtctgcatgagacccaagccaagaaagcacaaggaagattcccaacagcacagctaaggctaaaataactgaaatgacaactgagctggccatccaagagatagaattcccagcttgaatccaactaagtaaattgaccgttacgacaaacgaaaacaaagtcaacattctttgaaagaacatagcataatccagagtcttcacaacataatatctgtaatatctaggataaagcccaaaattacttgacatagaaaaactaggaagatatggcccatttccgaaagaaaggacaattaacagagaccaacactgaaatcacctagatgtggtaatttaacagacaagaaactaaagcagctattaatataactgtgctcatgatgtaaagaaaatatgtttataatgaatgaaaagatagaaaatctcagcagaggaatagaaacatttaaaaggagccaagagttcttttgtctgaaaataaaaagaaccaaggattcttttgcctggaaataaaaagaaccaagcattctttaaaaaaaatctctattcctctgctgagatttcctatcttttcattcattatgagcatatttcttttacatcactgagaatcgttataatagctgctttataatctcgtctgataactaccatatctgggtgattctacagctagaaaatgatacctgaaataaaaataaccagacgagcctaaaagtagaatagagatgacagaataatgagagaacttaaagagagagaaaaacaaatgtatccaatctgaagaacacagagaaagataaatatttttaaaaaacagagccttgggaccttgtgagattacaaagatctaagatacatgtaaataaaattgcagaaaaagaggagaaagaaaataattttaaaagatttgaagaaataagggttggcaatttctgaaatttgatgaaagacattaatctacatattcaaagagctcagtgaaccccaagcaggatatgtgtgaaaaaagtacatcatattaaaacagcagaaagctaaagataaactctggaaagcagccagagaaaagcaatacattatacagaggggaacaacaatttgaatactttgacttccttcagaaacaatttaaggccagaagtcagtgaaataatatatttaaagttcatgaagaaatacaaatatccatttattcagaattctgtattcagaggcaaattctctcaagaataaagctgaggtatattttcagacaaaattaaatgcaagaattcatcaccaatagacttgcgctatagaaatatgctatagaaaatgctgaagaaagttcttcaggctgaagggaagtgctaatggatataaacacagaccttcaggaaggcatgaagaacactgaaaatgattaagatcccatgataaaagtcactttaaaaaggtaagcacaacaactgtgcattttgaagcagcttgcaatcatttagaggccaattaatgcctgtcagaggcttgtcagcactgaactgagaattccttgcttggattagcctgtactgggctgtacacaggaaatatccgaagttgtctgtgaaaattgcctccatttaggggaattatatgtgtttcaaatggatttttaaataattaatggtgtagtcattatcacaaccaacatcctcctttttattcattttatcaggaaaaataatgatttctatctcaagttaagttttcactaaaaataaataaaagactctttttttaaaaagtgagctatttagtatcatcactgatagttaagaatagaaaaagaagatgctaacatagactctcccatgtgcttcaggggcattacttaaaatagaaaaaaataatgacttgcttgagaaaaatgaactttaaagggctgtgtcaagagagacttgctatgtcttattcaaacttattacacagagaacaataaaggaatttctcatttctgagaattcattctatctcaggagtctgattttcagttatcatcaaagagctgttaccggaaaggtgattataatgaagtttgacattggcaaattcgaatattgtacaacttaccgcattaggaaaagtcatggctttctagttgcctaacaaaaatgtagactattggagagtataagcagagaccaactctcaattcacaaacatgtcacataaccctgagaaagttattgtgtttctcagaagagtaaaatatgttccttctagggaaatgtcccagggcaggaatatctgagagctaagacatgtcctctagcttttcagcatccacaaaacatctttcttcttccagctgggcaaaaaagtgtaatctcttcttagaaacataaaaagttaaaaaaatatgtgatacagcttatctagtctttcacatcttcaaaaatccctggaaatataacagacctatgaacaaattttacctaaatgtttcaaagtacttcaggaataagaatcaccagttgctttaactgataataaagtaagggtaagaaaaactaaggggtatgtttccctaagtggttcagtcaggcaggcaaactggcagagctcagagccccctacccactagacaatcctttctagctacaaagaaactcaggctcatattattattcttctataaatacccaatactatatcacacgaatgagataaaaggtaaagagagcagcagaggttatggagtactatactaaagtaagcttatggggaacatttagtaagtgacagtactcctaaaaataaggagtgaggttttaattctttgaaaatctttcccttaaagcacttgatgtctgagctacttgtcttctgtattctccggttggatcagaaaagctctactttgggaaggaaaccctaacaaataccttcagagtgaagggctgaaaggtgacatgaaccccaggaaggcattctacctagtttggacataggtgcaggcaggggaaaaactctgagccactgaagagcagacagcaaaggaaatagctgtctcccagatttgccccattttccatcctggcattttgaatccagtgctgaaaccaaaagaatggtgatggcatgtggaaacatttttcagcaatttgcatttgtaaatctctacctgaaattgactgggtcacatcactggtagactacaacaaaaaaggtaagatatccctcctaaagtttttataccattctcctgcccacagtagatctgtgatatttttcatttcaacaatgaactgttagtgatttctggaaacacattataatgactgagtctgatctaatgataactttttctgaagcttagaaattcacacactactctataatggggaacaatgtactttcatatagaataaaactgaaatcggagacaggaaaatacatgaaaagaaccacttctgtgccagctgacatttttgatttatcataaagtaagcaaatcataaattgttacacattaattatctaactatagtttcacaaaaatgtatgtggatttaaattaatcttattcatgttttatgataggaacatgattaccagacaaatcagtttcttaataaatgtgtaacaaaattctacttagccagagtttctttttttttttttttaacagggtcttgctctgttgcccaggctggagtgcagtggtgtgatcatggctcactacagccttgacctactgggctcaagctatcttcccacctcagcctcccaagtagctgggaacacaggtgtgggccaccacacctggctaatttttgtatttttggtagagatggggttttaccatgttgcccaagctggtctcgaactcctgaactcaagcaatctgcctgtgtcagcctcccaaagtactgagattacaggcatgagccaccatgcccagcctaagactttcaacattaagaggaaaattggtggagaagagatcagacaagggaatggaaagcagaggatagggagatagcttctacacttatgtagaaatttgattctgagatatcatttaatataatgaagcaaagtacaaactcaggttcttaattaatgtctattatatgatacatagtggaaatacaaattaggtttatccaaattgtgttagtatgttttttgatggctgaaggccaacagccggtgttagtgcagataggtcctaaaccaagggtatgcagattatttgaatatctatctgcaaacagttcttcagagtttggaatggtaggcctgtaattctataaagaaagttattttagcaatcacagtatttcattttacaagaatactagtaatcaccaagtcccttttcctctagccccatggtgtaaaaccgcatctgagggaggatataagaggatatctcctagggcttattgttatggctctagtttttacacattatcaaagctttagctttgaatctaggccagctagagagaaacacataggttttaagtgattctgtagaaaaagagttcccacaacacacagaactgccagtaaagtcactatagacaccaacttttagtaaggggagggacttcattcagccttctcctaataccgttttcagttgtattagcagggacctcacacacatataaatcaggaacgtaaagcaatgaaaaagactcattagcaaactagtttgcttgacatatgctaccaaagtcagtgtctaagctccccaaaggcggaaactttttcttcatactccacatcctttctctcagcagagtaagaccgtgttggctgctggtagaaggatgacaatgagacaaggaacaggcactttgtgacatgaggaggtcattggttgacttgttctcagatgcaactggtaaaaaggttgaacgtcagaaactcactttgatgaaacccttggcttatgagttctatgtagcttggatgcctaggtcaaaaataaggcagcctagttgattaagtttttgagatgttctgattttcaaggggtgctaagaggcagccacaatttaagaggatggtttatttatttctcacaggatacctcctttcagtcctcacagttgcctgctatcaagtaaaagtttgcagaggtaaaaaaaaacaaggacaaaaataaaaacaaaaacaatgacttaaagaggcaccaatataaagtgaaagagatcttttaggtttagggaatgcaataccagagaaaggttatgagctatgtcccactttcagctggtgtagtactgaacaagatttgagatattcaaggtggaccttaatttaattcaatcaaacaagcgggaaggattttttggggtttctacagtctacaaggcacagcatgaaacatgtagctcctggaaagtcatgctggtcatgtactttatcatcaccactctgccaaggaagttttgttacaatattgggcaatagggtgcaaatatctcagttctctataggtcctaaggagtgtccagctcactggtacagctatctctactgtgagtctaattaaactcaagtatatatccgctagataagtaggcttgaaatattaatggcaaaaactgcaattacttttgtatcaacctaataactacacagacccttgatgaatatgattgatggataatattttatggccacatagtttgcaaaagtgttgtgacggccaggcatggtggctcacgcctataatcctagcactttgggaggccgaggtgggcggattgcctgagctcgggagttcaagaccagcctgggcaacatggtgaaaacccatctctactaaaatacaaaaaattagccaggcatggcggcgtgtgcctgtagtcccagctacttgggaggctgaggcaggagaatcacttgaacccaggaggcggaagttgcaatgagctgagatcgcgccactgcactccagcctgggcgacagagcaagactccgtctccaaaaaaaaaaaaaaaaaaaaagtattgtgacctaggcaaatcagcattccaaccagaggctcccttcctcctgcaaaaaggcaatgtactgtcacggctttccttaaagggtggggccattcagtcaacttcttctaacccaaagaggagttagaagtgtacgtgtatcaaagggaaggtagaaacttaatgcctattctgcttttctacaatcataagacctactgagcatttttctctcgacttttattcttctgaactgaagactggatattttaaatttagcgtgtgaaactcccctcctcctcttgatcactttcattacccttctaactccctgagggcaaagatcatttcattctatgttgcctatcatagtgcttgagatggagaaagtgatcagtaaacatctgaatcacaaagttgaattttgtttgttgaaggtgaacaacatgaggcagccctaggattctaaaaccattttgtgctacagtaagataatagtttccttttctcccctaattctttaaaaaacaagtaaagatgctattggctatttgtgactctaccaacccattggatggctgtcttcagggatttctttctagtgactcccagatccctttgccgtgccagaattgatggctcagatactatcagtttataaacaggatttggcttattttctcctaaatgcttttcatggttttcaaattgttctcacacaaacatatctcatgtattctcgtgaaggacagagagaaattactatccttattttataggttaagaaacaaagatccacaaaggttaaataactagctcgagaccacaaagcattttgtaccagagctcacagtgaggagaataatttctagtccatttgctagctttgtaattttgtgtaaatcacttaacatttttacgtttcagttttcctgcaggtaaaatatgaaatctatacctactcactatcacttatgaagctgttaataaaaactgaagtaatactatttctatttttcaaactttttacacatttcctaactcatctcatcctataagactggtttcattattgtctcgaatttacaggtgaagaaatagaggctgagaaaggctgaataacttgctcagtcacacagcactaacatgtcagagctgagatttgaattcatgtctggctctgagttcaatacttttttcacttcaccatgtctactgtgaggctcacacaggtgagataaccaatgtgaaagcactttataaatgtaaatatcttgtaaatgctatttaaaagttaaggaatatgacaatttacatggatagatataatgggactgctaccaggctggcaaagaggaccagaaatgtagttgaaaagttgctgcatatataaattgaaaatattgggacttggtaaggaagttgcccataggaataggaggacttgaggcatatgtaacaggattttcaatggcagatcagtgaaatctcccatctcagtttttaatctttgatgcagaagagcaatctaatcacatcacatttattctagtgttatgctaaaaatgtcacttgagtataagcagagaggtgtgtgccaaccttaacctaagatcagagtcctgttacctttaaagcttccacctataaagatgactaaatgaatttgataaaagaagctcagaaatttcaaagatccagtataacaccaggcggcttccgtccttcactgtcaagacactctaaaaaatgtaagacagccctaatattactaacactagaagcgcaggtcagtaattattgttgtacccaagactagctcgctaagagaagtaaacttataattatcccagctacattttcactactaaggtttccatccagcagaatgcattcaccacagcacaagcacatttattacccttttgacagcaggtggtctggacacagtgacaggctatagaacatatcttagtgtttcattagggccttattgtgaccatgggagcttggcactatttaattctggctaaactccagatcaataacttgttaacgaaagaaactgtccccccaaggggctaccagaataaaaagttaccaacctcagcttgtttgcaccacacgctgatgttcttccgctgggcttttgtgaagtggtcccatgccttctgcttggaggcggaatggtacacagccactatctgctcaactgcagcatcaaatcagcagttggatcaggccagggtatcatccagggatggaaaaagagaggagaaaagaaatgaaataaaagagaagcatcaggcttgttgtatcttgttgttatgacactatactaagctgtggttgtgcttggaaaaggctacatgtgttggggtactttgattttaaaggagacgcaaaggaaaagacatcaacatacagaaagacaaaagggaacaccagaggtttggggtaaaatggtaacaactagagttttaatacaggcattgtgaattcatggaggcaggagaggaagagtcatagcaaatgcacttttatttagtacttgtctttagtttagtactagtgactccacacagcatggaagaaaatggcaaactgtaccagaaactctctacccctggctcctttcatagccctctgacacacacttggatgccttgcttcaacagaattcatgcttttactattctgaggtatgtttaacaagaagcatcaaatcaaaacctaagatggattgaatcttttttaagtctaccaagatagactcgttgactggaaaaatataagttttagggaaggatgctgtgtaagtgcggtcctagagagtatttttcaaggtctcttaaaatgtcaaacagggaaatgtgtgcagatgttctggggctttatcctaatcacagttcaagagaggggaagcttagacatgactcctttgggaaaagaaaagcaggacaagagcccctgtctggttgggtgttcacagtaagaaaatccagaggtattattttttttttctttacatccctgtttgcaccctgtcttctaatgacttaaggatttatagtcccatgatgcgtgctgctttctctttttaaaaatttatcctaaagtcctgaagacatgtgcttttgcctcctggattttatgcccatatatactttcaaaatacaagtggcaaatggaacaactcccccttaatcacaattatgtatgagtcaagtacagggaagtcaagtttggaaagagtggaccataattgtttaaaagcaaaatcataaaattatacccttattcttaaggtgaatatactttcttactgaaaaaataagagtgtataattttataatgtggtaaacaaaaaattacttgataatttatctgatctggctcatttcagagaccttagataggtttggagcggaatttctttttaaaaatggccattttggtagcttctcaccttgtcccagtgtctatgacatccagcaaaggtagcagaagaaagtaaactaaataaaaaatgtagaagtagcaaatttgatttttatccaatcaccttgggaaatataattacattgatcattgaaatggagtttcttgaaggcatattacatgatgataattatacaaatctgaagaaaagcagctttaaaatgctgatgctacatcgtaactttagcaataaaatacccagccctctattgaggcccagggctgtagaagtataggatgtggcctaaggatcagtgtttctaaggagttgaagtagatataccagagaaaatgaagctagcaggtgcgcacatgtctcctgtgaaattggagcttgggcatttgacaatataaggagagcacaaggcagtgaaaaagggagccttgagccttaacacaggatggctctggaggcctgagctcccatagagagcaagtgactaagtgaagtgacttattctcattccagcagaactctaagttccactcacattgaatgagaattccagaaagggcctgcttgaacttctcctttgcttcttccatatctttctcatgggcagctttctcgttcaccaggcggcggacatggctgttggccgactggatcatggagtagaagttattggcgctacgacggttgacctctcctcgctctatccaggtaagcaaggtctgtacagcttctgagaatttggaatcatctgaaaaaaatatatttttataaccaacaaaggtaaccaaattttgatctattttcccaacatgctggcaaagagggcatcatgatttttggcagtgatgggtaaatgaattgctgaggatgaggagccacacatacacacatgtgcacacacaggcagtaggcaggcagacaaacaggaagaatggaaggatcaatgtagtcagactggttgtggtctgtgatgaattttcagaaagagaaatgtttccttgaaaaaagttttctgtactgatatataggtttcatgtattgcaaatttcttaccctctctgattgtgtgtgtgtgtgtgtgtgagagagagagagagagagagagaagggggaaagggggcagaggggagacagagagacagaaaaaaccatgaattagtgagggaacttcagaattctacagtcctgtgttttaatgaggaaaagcaaacttgaatcctgagtttaacttgaatttaacagtaactttaccttggatccatggaattacagtgttgggaggagcctcagggaagagttaattaagtaggtcattctttagatacaaacatgcacatcttcgaccttttatagtatcactcctgtgttcaatccacagccccaggccttccactcagtcccactcacaatctattttgatgcaatttattttatttctatatttctccacatccttttttctcttgcatgaagaacctccatgtagatttctgcagctagttaggagttattctgtgattagttaagatagtagcacagctcttccaaagcttctggttcagctccccaagatagccacttatgccttctgttcttaaaggctccagagagggagagtacatttggatctattgaagcccaattcaagggcttcacatccttctctggctagaaacccttatgttaaatggaaatttccttcactgcagtttgaacttcttgcctcttgcccctttttcagtgcagacatataacaagcagtcagcctcccctttatagcagcttttcactttattacttagatatagactttatgttgatgctcagtttttgcttctcttgaaggtcacacacccattaaattcatttttttaaacttaaactgatttgtttggtgttgtgtgactaggcaagtcttggacctggcgtcttaccaatgctttcagcctttccagtttttcaaaatgtaccattatttctgtgcctctattctggactctaggttttctgcttttcccttaaagaaagtcaaaaccaatttcttacatgtgtgaatcccttaggctatgtggtacaaacatgtctggtgaaggagacctatttggaaagtagggttagcagtatcttgatgagttgagaacacaagaagcagggaaaattcataccattagagctggattggtgttaccaataagatcaatgggacaccagcattcatccaataaaatcatctatactcagaaaatgagaaagactggatttgagctactaagacaggagaccaggcagagcaattaatgttaaattaacaaaatggctgagagtcaaacaaggggaacaagaatcaaaactaatgggaaagcagtctgattaagcaatgtctacacgtttccacagtcactgttttaaataaactggccttttaaagtgatttaaaagtctttatgttttagttggtggtggctaagtctttgagtcatctaagaagaatgtacagcatgactactttctggacctccattttctcatctttaaaacaagaattttaccagagtttttcaggatcacatcaaatcctatcatcctgattcactcatttgacttggaattataacctaacttgtatccactataaaagagggcgcttacaggtcccaagtcatagatcatgcctaaaagtctctgacgtggaaagtgaggaaaacttgtttatttctagtcacctgatgtctgaagagaaaaatgccatcccttgagacaatgaaggagcagacacaggtagtagggataaatttcctggttcttgagttactaggtacacctctctatctgcaaggctccaacacaagaaatgcttagaatccattagtaggaaactcaaagtgtaactgtcaacaatgcaattatatttatgacacttctctaaagaaaagagttcttttaatcatgaagcttgagtgcctttgataccttttaatttttcagcaacaatgctgcattcatgatctgaatagtggaccactgggggtggagatggtggacgcaatctttcttcttccattcttctacgatggcgctcctctctggctagcatacgctgtttacactcccactcatacaggtcatctcgagcctgtgcgaaatcaacgtggagtctgcctgtgtccttcttgtcagtactagagcccaggcgaatgcggtaacctaagtccacaggagggtgaaagggagaggagagagggagagaaggagagaagtagagggagagagagacagagacagagagagagagagacatgaaagactatacatacttttccaagttcagtgtttcagatgtcactgcagcagttccaagtgaccacacaactccaaattctctccccatgcttagcaagtaaatcatcaaaagatttagattatctctgataatagctcacattctatgggttgggttagtcttgttcttaagagttccattcctccatctaataccttacctctggctgaggttggctccgtgggtaatagtatcaagcatgatcgttatatggcaccaagggctgggaagaatggaaaaggtggcctcaaacgaacttgtctttaaataaattcaagagtgtccattatactatcacaaagattttggtaaaacttaaatgcattaacttggtattttaatccctaaaattgcttcctagaagcatttgtcaactgtgagccattttttttctaaaaaaaaaaaaagatggggagtgatgtgtgacccaggtgacatataatttgggatccttaaaaaaaaagatgtagtgtgattataatatagtagtataggactgggattcagaaaacctgattcaactccatacctcctctttctgtgccagctatacttacccaagtcatgtatcttaaaaaaagtggggaaaaaactaagtactttttcagtttcaagagctcagctagatacttccataggaatttatctcatttcattatcagcacaagcttgcagggtagaagggtagaacattataccaaacagaaaactgagcatcaaaagaggttagggaggttaagtggcttgccctgggtcagacaattagcaaacagtagagctggctcttgaatccaggacattagactctgtgctttcctttattctaacctgcctctcaagaataatacccaacatagacttttgcttctggctaagatagagtaacgggttagatttgtcctcctaccttaaacaactaaaaatatggataaaatatatgaaataatgctttttaaagaactgtacataagacaatgaagacagggatcactgagagacaagaaccaaatgaagtgatccctatgattgccccagtttatttcctaataagaaagtttcctaataagagagtttttgggcctcagcacagggaagggaactcagacagggcacgatggtgttcccaagttaaggagactgaactgggagtctaggaagactatggaaatagagttcataaggcagagtaccagaaagaagaaagctgcacagagaaagagcttcagagatatgcagagggtcctccactattatttagctgagtactaatgtctatatgtgtgggaaactacctgagcattagaggtaacaatccctgaaaagctcccacagggttgggaatagctccttttcctaccagccagagcagaaaaactcacacttctggtactgggtgatcagaagggttctgccttaatagtggagaaaaattagccctaaactcctctggtcttgctgaacaaagcttaagaagcaagacctaaaaggaccaaaattttcccaagttacttaactgcatttagaacaaaactcaagactatttatagaaataaaaatatgccaccaaataaggtaaactttaataaaaaaattacttggaatgcaacgatgcaggaaaatatgacccataataaagattttaaaaatcagccaatccaaacagacccagaagtgatgcagataatttaattagtagataaggatacaaaaacaatgatgaaaatttgatttcacatgctcaagaagctagagaaaagactggtcatactaaggagaaacatgaaagatataaaaagagccacaatcaaacatctacaggcttaagctacaatgtctaagttgaaaaaaacatcaacagacaggactgatggcaaattagatgctgcataagaaaaaaattaatgaaactgggggctcccagcacctgagccttctgcctgcacccacctgagaattctaatggtgactggggaccagcctgccctccctatcgcagccaccacctgaaccctgggggcctgagaataagcctgctggcccggtcctggtggagtccctccagggcccccgcacaccatccagtgggccacttaggggcctgggaattgaaggactgcttagctcagtccatcactgctggcgcctgaccacttggcctgaggcctgaggttgggcccaagcagccggcacccccacagttgcctcccactctcacatgctgaaaggcagagtccctccccgtctttacacagagctgtgtaaaagaataggtgagccacaaagctgtctgtactgggctgagggaagagcttcctccccaaagtcactcctttcagctacatggtagcctggagatagatggacagtgtgtaaactgagtcaggagccccaggagagggttgtgacagagaaacattgtgatcctgcctgtctaagaagtggagctgatgtggccccctcatcccctgaagagacctcggcacatttctccaagagttcccctagccactcctgtcaggggtgctgcctgtgctcatcattgggttattcgtgggtgagcttgtttgtccagctccacccagctttgtcctccatccactctccctgggctgaatagggaacctggaatttcacagaccagcccatcatctgaaagaacagagagcacctcacagtaagaaaacatccagtacataccgatctgcttctgccacaggtggctcttacctgtaggcgccacctactcaccaggaggttaaactgcacagcacaataggacacctgctgacagaagtgcacagggctaaagaagcaaagccaaaggaccctacccaacatacgctacagtcacatcttcggagttgggggacgtcccatccaaatgaaattagattcaaaaataagaagtgacagcttccccacgtgaaaaggaaccagtgtaagaactcggggtgttgcaacaccccgaaaagatcacactagctgtctagcaatggatcctaatgaaaatgaaaattctgaaacgacaaagaattcaaaatatggattgtaaggaagctcaatgagatccaagagaaagttgaaaactaacacaaagcaacgagaaaaacaatgcaggatatgaaagaagagatagagatcttgaaaaaaaaaaacagaacttagggaaattaaaaattcactgaaggagttagaaaatacagtcggaagctttaataacaggctataccaagcagaagaaagaatttcagagcttgaacactggtcttttgaactgaccctgtcagacaaaaataataaaaaaggaatttaaaacaatgaataaagcctttgagaaatttgggattctgtaaagcaaccacacctatgagtaataggcattcctgagtgagaagaataaaagtaaaaactttgaaaaacatatttgagggaataatccaggaaaatttgcctggtcttgcaagggatgtagacacccaggtacaagaagctcagagaacacctggaagatattttgcaagaagaatatcatcagggcatataggcatcagattatccaatgtgaaggaaaaaattctgaaagcagcaaaagagaagcatttcttttctcctgtctcactggattatatgaagattgggcttttggatgtgtgaatttagtaatactttaaaatgtaaatgcaggctattatcctaagtgaaataactcagaaacagaaaatcaaataccatgtgttctcacttataagtgggagctaaacaatgggtacacataaagatagataatagacactggggactccaaaagtgaagagtgtgggaggggaatgagggttgaaaattaactattggatataataatcactatttgggtgatgggtatactagaagcccaaagctcactattacacaatatactcatgtaacaaacttgcacaggtgcccccgcatctataatgaaaaaaatgaatgaaattgaagacctagcaatagaaactatctgtaataaaatacagaaagaaaaaagactgaaaaaaaaaaaaagaacagaatagcagtgagctgcgagacaacttcaaggggcctaatatatgcctaattggagcaccaaaagacaggggaagagaacagaaaaaaattaaataaggggagaaaatttttcacatttgatccaaactcacagatccaaaaagttcaatgaaccccaagcacgagaaacaagaagaaaattacatcaaagcatatcataattgaattgctcaaaaccagcaataaatatctttttttattattattatcatactttaagttttagggtacatgtgcacattgtgcaggttagtcacatatgtatacatgtgccatgctggtgcgctgcacccactaactcgtcatctagcattaggtatatctcctaatgctatccctcccccctcccccaaccccacaacagtccccagagtgtgatgttccccttcccgtgtccatgtgttctcattgttcaattcccacctatgagtgagaacatgcggtgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatatgtctttatagcagcatgatttatagtcctttgggtatatacccagtaatgggatggctgggtcaaatggtatttctagttctagatccctaaggaatcaccacactgacttccacatggttgaactagtttacagtcccaccaacagtgtaaaagtgttcctatttctccacatcctctccagcacctgttgtttcctgactttttaatgattgccattctaactggtgtgagatggtatctcattgtggttttgatttaaatatctcaaaagcatccatggacaaaagacacattatgtacagagaaacacagataaagataacatcacatttcttgttggatacaatgcaagcaagaaaatggtggaacaacatctgagagaggacaaacatctttcaaaaagaaaggtgaaacactttttcaaatcaacgttgaaagaattcatcaggaacagacctgctctacaaaaaatgttaaaggaaattcaagcatagggaaaatgacaccaagtggaaatatggatctatagaaaggaaggaagagcatacacaatgtgtgattccatttatgtaaagttctagaaaatgacactaatctgatagagaacagataaatggttgcctgaagggagagtggtgaggggtagaaggacaggattgcaaaaggggtgtaaaggaagcttttggggataacagacatattcattattttcattgttggtgatggtttcatacctgaatacatatatagaatattatataattgtatttttgaaatatgttaagatcattgtatgtcaattattatacctcactaaaattaaattattatagctaattaaagctgttacaaagaataatattacccagtaatgccaaaactgtcatacattctttttagaaaaaggaagaatgaatacatttcataagcaagcctttctagggctctttacagtttataatacacttgcacatccattcatcttatttgatcatctgagccatcagaaaaatggggctaccaatgattaccttgcctattctcccagaactgtggagaggatcaaatgagaggatgagatgaaagctctacataaacctcattaaagatgctacaatgctatggggtgggtgcactgtgcacagtgccagctcccaaaggtgctccaattccatcagaaaaaaaatgaagatctccacattttctagcccccttttgtaagggattttttttttgtttcttttaactgctttcttttacaaaatgagataacagccaccccattcaggagattgctagcacttgggcactttcagggggacagattcaaatttaaagggcaaaatttagttgttttcatatcactgatggaaatcccctttcttttggcagccctaagaatgtttctaggaggtggctgttaacagagagctgattttggtgatgtttagatggatgcttcctgaacagtatattgtcttttaagtacacctacgcagggttttttgagacctttatgttcttattaaaatagtctcgtggaatgctctgttattattaagtgctgccgaatttttggtaattagattctatagcacttaccaaatgtaaaaagagtattctccatctacacctcctcctttccttacccatgttaccagcctactttttcaaacctttgttaccttttccctggcctattacaacaggcttctaactgacctcctctcctcttttcacatctctcctctaatacagttttatatagagctgtcaaattaatcttgcggaaataattatcttccttgttcaaaaatttcttcaattccctattacctgaggagtaaagacccaactgttaagccttttggagtgtgctaataactgatattttgcctcctcctctcatgtctacttagtaaacaaaccactactcactgtttcctgaatgtttgccaaagcttaccacctttgtacttttgctcatgctgttttcatgccccattgtccacaagcaaatgttttccctttgtcaaagacttggtccaaaagctacctttcttgatgcccccagttaggagtcagaaatattctcgttctccctctcctaccttcctccctcacttcctcctccatggcacttataacttttaatctcttattagcagtgtgtgtatcatatcagtgtattgagtaatgcctggcactaaatacatttttctttaataaataagtgtatgactacatactaaccctaaattcattaaggggaagaactaggttttactcattttctactctgcatagcatctagcacaagagtttacagaaaaaagatgttcaataagtacctgttataccaatgaagatgctgtcatcatgaaatgtctagcacttagactcaattcttccaaaccattactgttaggcaaagaagtagttcaatgtggcagtattaagagctggggcctttaagaggtgattgggtcatgaagtctctgtcctcataaatggattaatccattcacagattaatggattaatgggttgtcatgagagtaggactagtggctttataagaggaagaaagacctgagctaactctctgcagagagcaagaaggcccttaccagatgtgccccctagaccttagacttccagcctccataactataaaaaataaattccttttctttataaattacccagttttgccaggcatgatggctcacacctgtaatcccagcactttgggaagccgaggtgggtggatcacctgaggtcaggagttcgagaccagcctggccaacaaggtgaaatcccatctctactaaaaatacaaaaattagccgggcgtggtggcaggcgcctgtaatcccacctactcgggaggctgaggcaggagaattgcttgaacccaggaggcggaggttgcggtgagccaaaatcacatcattgcactccagcctgggcgacaagagcaagactccatcttaaaaaaaaaaaaaaattacccagtttcagatattctgttataagcaacagaaaatggaccaagacacaccctaaatctgaatttttactataaacaggagattttatgcaaagtagttcttactatctccactccaaccactgtactatacaggccaccatcacttctgggttagactaatattacagctggttaacttagttcccagtcaccactcctgctcatacctctcagcccatcttctgctcagaagtaacatttgtaaaatgtaaatcagatcatgtcactgaattccttaaaatcctccagtggcttccagaataaaactcattgtcatagttgcctgcctttcagatttcatttccctccactccctctctcattttctatgctccagtcatactaactttctatcctctgcttgaacataccaagtccattttcatctcacggactttggcttggtgttccttattttggaacgctcttccccaagatgtttacatggcaatctctcttcacattattcaagtctcagttcaaatgtcagagaagacttcctttcctaacaactctgggtaccttaaccttttttatcttcctcggagcacttagtactgaaagtaacttatttatttgttttcatatatattatattttgccatttccagaatgtaaaatccttgatgacaggaagtctatctgcctcaccctttgctgcatccccagcaacctagcattctgcctagcagtcaataaatatttgacaaataactgacttccataactatttatgagtatctacttttgtgccaggttatgtgctagatgctggggattcaatgttaaataagacacagtccctgcccttaaggatttcacgttctggtgggggagatggatgtggaaagagacagttctagcatggtacagtaggtgtcatgttgggaggaagcaccaggtgctgtgaaagccctgaggaaggagtgcctaaagcagtgctgggcagagtggggagacaggtcagagatagctttccagaggagggtgtgcttgagctggagctttagggggtgtgtgtggtgggcagggtgactctagtcagaggaaaaggcataaaacaccatggcacattctgggaattcgagttcacttagtgtggttgggacatggtgtgtgagggaaggaaggactgggagatgactctaagaaggacagcccacagtcaaggcctttagatgccacatgtgaggagtctggatttatcccatagacaactgggagctactgaagagctttaaaggaagaagttgaatgggaacattcagtttccacctctgaaggcaagagcaggtaatactaagcccaaacttatctgctatagacacaaatagttctatctttaatatctgcgttgtgcctggtgggcacaatcctcacatctaaacacctaccagacagatacagggctttgtccaccatgtactcctcagcaaagcgaatgtggcagaagttcttcttgctcttgcgaatggcaatgatctctccacactgctcgaaaacttccacaatgatttgctctgtcccattttcaggcagaccacccacaaatactgttttgcatcctggtggtctttctcgggttgcaggaggtgggagatctaagttgtaagggcaaaaacatttgaaattaaaatgtttgcttgggacagacctcttcgaaatctaacatttccctgctatccctgtcaaacttttgtctaagagtgtcagaaggatgtggcctctgaggtgttcatctctgctccacagaaaactgactgagtgaacctgaaaatcattttattcaatcgtttgctgaccatgatatctggagcataaagacccaggcctatttgtctgtcccatccagagtcctttagttttgttcgttacttttgttgtgacaatccagctatgccaaatttttagtcatttttattaagaaattagtgggagaaaatcccactcagtttaaactgttattttcaagagttctcagaaccagggttcctgaggaaggatttgtttaattcagattgtagttactacattctctctgttaatgctttttgaaggaacagattcaggattaatttgacaatgatggggtacctacttacaacaatgcctacagctgtcagaatgatttggtttcacaaaatcagtcagagtacaaaccatcccttttatgttgtttttttcaatatcagtgagcctttcctcaaattccttgctggagaggtgaggtccagagtctgtcttgcagcatttacagggaaatatgaaagacagcagagaaaataagctcgtctgggaaatcattaactaaagtgagataaatttggccatagagaatcattaaaaacctacttaatgagatgattctccctctgcttcaaaaaaatatgcactcatcttaaacataaagcctgttctatctgccagctctttgttgctatttatatgtatcaaagcaatttccaagcaaactcctacagtttgtagcccaacaaaacaaagcatgatggtcatgggttttctagtgttggttttgtatccgcaaggatttattttgtgtaatccattcttttccattcagctcttaacaacaattctcctagctcaagatttggagagctcaacaaccagtgattatagctcacatgcaaaaataaatgagtcatgttcatagattaggccaaggcccccaacctgactcttatccaagttggcaagcagttgatttgggagcctccttgggtatcaggatctctagcttcctcactttgctactactctctgtcttgttggtgtggctaagaataatcagttactcataatactctctttccctgtatttggtcaaaaaaaggggtaaagggattcagggaacttacaaactttctgttaatttttacaagtctgtaatttcaagacctcactgtactggttttttgttccatatgaaaggattagagggaaagggaaaataacctagtgagcaggaatctgaaatgtcttagtcacaagcactgaagaggttgtagtttgggccaaaatagagaagatgaggtctagaattgtttgagacttatgcttttgagtttttaagaactggaagggattctagccatcacacttccagtgattcttaactctggtggcacatttgaatcaatttggaagttaaacaaataatgcctgggtcccaccccagtgggtctgatttatttaattagtctggggtgcagcctgtgcattcgtttttttttgtttttgttgctttttaagcttctcaggcagttgtaatgtgtagttaaggttgaaaactattgacttagtctaaatctctgatattacagaggaaaaagcttagtgaggttaaatgtctcattccaggtcaccacattagagagaaggaacatgaacttggagcaggtaaacctaaatgtaaatcttaacttcataactgactgtataaccttgggaaaattatataacccctgaaaacttcttccttcatctttaaaacagggatgctgttcccaccttacaagggttattgtaggataaccgataatatactgtctatattgcatgtggctcaatgcctagcacttggccggttcccaataaatagcagtcattgtagcgttattattatttactattatagaacccaggtttcttaattcccaatctgggactttctaaagtcctaccagaagtctggagtagagtggtagctaagacctgaacttctaaacttccagatcttagtgtcacacagatctttagacaaggctgggtttgagaaggaaccactcatatggatagagaaatctacagctatgaagatacatatggctttgaccatggaacacaacccccccccccaccgactatataaggtaaagaatttccaagagtatccatatagttagaaccatgttttaaaattagagactttagaatacaatcctgtttcagaatcaaaaaggcttcctaagtttactatttaggagaattaggtggcaaagaatccttttgtgaagttagtaatcacttttataccatttgagtttcctttagtctacctttaggtccactgagagactctaaaaagcatgtggttactgtggcagttacatgtaacactgaaaaggcaaaggctccatcccctggctacatttgtgggatttaaaaattctttggggggctgaggtgggcggatcacgaggtcaggagatggagaccatcttggctaacacggtgaaaccccgtctctactaaaaatacaaaaaattagctgggcatggtggcacgtgcctgtaatcccagctaattgggaggctgaggcagaagaatggcctgaacctgggaggcggagcttgcagtgagctaagatcttgccactgcactccagcctgggtgacagagcgagactccgtctcaaaaaaaaaaaaaaaaaaaaaaaaaaaaaaaaaaattctgtgatgaagtcatcaccctatttaggtgctgtgattcttctgtggtgactgttttctaagtaaaagggcataaaagccactaagagtaatgtcaagaatgctgaggatttatttattttccttgggtaaatgtagaaagcctctttaatagcatttgctgagatttaggggtatgccaccaagcagggcaatgggctatactatcttccttaatggatagtacccattccttaattaacagctcaaagcactttgtcgtctgggcctgattttctaatcccactgaaatacagtgatcagggcacagcaatgataacccataggagagcaaattcaaagcccacctattaatcaggtaatgtgctaagctctatagcaccccaatcaccactcaggatggagacaaagaaaagttccatgtacaaagattcaagataactgggaataaaaagaactctaatctctggtaatggaaaaggaggagcttttagcaattctaattatacccaagcatctactctggggagctatgttggggcaatctgagtcattgctgatctttgagaagtgaggcaggaagcagtatagagaaccgataagccacttgaatcttgcttttcaaaggagcatcacagatcactcagctggtttgccaggatttatatactgcaaagtctttaagtcgattttattagacagctcaagattgaaggtcccctggacaatcagcaggggttaaatgtatcttaatgtaatcccaactgattggaaaaattagaaggctggggaattttaattaatgctcaatttctctaactctctttatagcattcagccctgagagtcttcccattttgatatggtaaaatgaaaacattgttcttgctctttttctggctcctgggtattttcccatgttcctggagacggatagcagatgatattccattacttattccctgttcactgttatttcccagtagactcaaaatgtaacctctccatagaaggtctaatcgctgaagtgaaaaatcttggcaaaatcaaattttctggagagaatcgtattacccttttttttcaccactaagaactgctaattgggaattcagtaaatctctgatagacactctgtgaaaaaaaaaaaaaagtgtgttccagggcacttatttttttcttgttatatctcagtttcctggaaatcagagaatgttgcttctgcaacaatggggtactcactcaccatttatctttaggagactggtacttggtctgctccagtctagtttgatccattgactttttagaccaggtctgattttgcctagtctacaacagagaagttaagatccttatcagagatcttatggctatttagtggtggagagctgggatatgaaaccaggctggcctgtgtcacttctgagcttgaaaacttacccattatgctatagtgcctgctccagagaaggtacaaagctctacatgctacctgccaaccagcccttgcttttcctaatgcattttaaagggcttttgcctatgtaaataattattgtggtagctacatttttaatgtagagaatcataactttagagctggatgaagcattagaggtatctaggctaatctaacacaatatttttgctttacacacaaggaggttgagaccaaggaggttatatgactatccccagatcccacagctagttagtgacagacttgggaatagaacacagttgtcttgatttataaactggtagtctgtcctctatactataataccattttttgtacatttgatgtagacacacccagaatagtctagtaggcagttggctacatgtatctgaagcttagaagagatatagactaaaaatatagatttggaagtcattagcatgtagtagtaattacctcatactctcttgctttgctttctagacctctgacccctccttctgtcatcatccatccaatcctccctcccaccatcattcaacaaatatttattgaacacctactatatgtaagacacttttctaagtgctggtgatacatcaggagacaaaaaagacaaaaattctgccttcgtggggtttatattctacaaattatatagttggttaaaaggtaataactccagtatgggcaacatggcaaaatcctgtctttaaaaacaatacaaaaattagttgggcatgatggggcatgcctgcagtcccagctactcgagaggctgaggcaggaggatcacttgagcctaggaggtggaggctgcagtgagccaagatcacaccactgcactctggcctgggcaacagagggagaccctgtctcaaaaaaaagaaacatgttttataaaaaatagagaaggtaaataggattgggactgtggcagagagataatttttaaataggttatcagggtcactgagaaagtgacatttgagcaaagacttgaaagaagtgagagagttagccacgcagatatttagaggggaagtgttctagctaggtggaagagctagcgcaaaggccctatgatgggagagtggctggtgtgttcatggaacagcatgaaggtcagtgtgaccggaacagaggaagagatggggaggagagtaggagatgaagtcaaagagacaatggaggggaggaacagatcatatctgaccttctaggcaattaaaaggactttagtctctattgtgagtgaaatggggagccattcaagggttctgagtagaggaattacatgatcagacttaggttttaaaaggatcactctgtctgttctgttcagaatagactgtagggggcaagggtgaagaaggaagactaattagaaggctattacaataatttagaaaatgaatcatggcagatacaaactaaatcatagcagtggttattgtgaatatggaaggattacagacatatgttgttaggtagactgacataattttctcacagattaaacgcactgtgtgagggaaagaaatccattagatttggcattcactatttaagtgaaaatgccttagagtgattcactacagttttagttccgataccttccatgtggaagtgaaccagaaaggggtatgcttgaagttgggctggaggagagtgtgaggagtatgaggtcaggaagtagttgaacctgactaaatggcaggtatgtggcaagtagaagtgatggattgaagacagtcatatgaagcagacaagtaaaaggtttttgaggtcaggagttggactatgaatctgtgggcagtgggagccacaggacaattttatggttctatatatgtgacaagcacttggatgaaatgtcaggtgggacacaggggagggaatggatggcaaagatactttctaataaagcaacaagaattagaagcagaccgtatgagtccctgaatcacaggaccttattgctgagaggaatttcagaggccattgagtgtaagagaatataccagaggcaggcaggagtaaggagtggggtttataattgatatggttcggccctgtgttcctgcccaattctcatgtagaattgtaataccccatgttagaggtggggcctgatgggaggtgattggatcagggggtggatttctcatgaatgatttagcaccatccttttggtgctgctcttgtgatagtgagtgagttaccgtgagatatggttgtttaaaagtcaggagcacctcatccccactctcttgttcctgctcctgccacacgagacacctcgctccatctttgccttctgccatgattggaagcttcctgaggcctccccagaagcagaagccactatgcttcctgtacagcctgcagaaccataagccaattcaacctcttttctttaaaaatgacccagcctcaggtgtttctttatagcaatgtgagaacagactaatacaataatcaaggcctgatcaggcagggttggtgggctgagatgataaagggttcagtcacaccaaatccctgttcttcctttcctaccctgctcttcccatctcaccttcacaaagcaatgtcttggggccaccaacaacaatgtcacttttgccatgctttcagcagagaactaagagaagcacttctattagtgttttctccacccaagtaatccaagcccactttgaacaaaactcaagttctaaaaagcaaacagaacaccagtttactttaagctgtgtcaagagttttatgtttgaattcaattccaaggccaggttccttcccagaagccaccaatttactggtgctagttgccccgtaagcattctcaatacaaggatgaagaactaaaagacggagccatgggggagatatgctgccctctcactctgtgagaggttcttccaactcagaactgtagaggcatggctgcaggtggggaaatataaaaatgtatttgagagatgtcagtccgtttcttttactagaggctatcaaaagttagagccttcttaagctatatatttctagattcatttgaagactgctcaacaatatggtctatgtgtcataaacaaggcatctgtactttagaaatttagaaactgaacatcctgtaaagtaaactactgcaaccaacctggacattacaggttgtgagccatcctgttagcttagatatatttgagacaatgaaagcctgctgcaggctgattatgcgataaatgaatgattaatcagcaggattctaccctttcataagcaggaggttttaacactggcagtgcctaagttcatggctttttgtgtagaaaaggtactatcaggaatacaactttctctaatctgaaagcaacatgctgaaaggtaaaaaaggccattgcccacttgtagggacagtggaactaagagtaagagacagataaaatggtgctgctcattcacttaggcactaaacacaaatccaggaatggccatttgagctggcaagtaaggcctgcaagggccatcttattctccattccctaattctccttgtgacatactagctcttctctcaatacagtcctctgagatgctggcctcctagatttcttattggtctggaaggatgtatcttgttgacaaccacgttcaaaaaccagaagaaagcataaagatctgttttttttttctagcaaaagaggccaagatgatctatccaaccaacctgattgattataaaatcctctcagttatgagcagaccatactaagtaaaatctgggtccctgccagggcttgggccatgattaactgattcctattaaaggtaggagatgaaatatttgtctgaagtcacatgtcaaagattcatatttatcctgataaggcaaggtcatttgatctatgccctaaaccactgaatgtatctcttaacaaacagctctaatctttgtactgcagtggtggttcccttggtatgccacccagtatgactagaactatggaaaaatcattaatgaggcttggggcacatgcagaatcagcttctaatcactgaatgtatataaaaccccaagtgcatctggaaaaaaagttttagtcaattattattagtgggacattttaagtaaaatagggccaccctatctttacacatgttttaaagtgaatctaaggagaagcctcctcattactgacaaaatggatctctagattacttccacatgaactgcattgactggtggctatgagtagtgtgacttagtctcaatattcctctttgcccttccaatatgttgagccatgcctcactgtatattacaacccatcggttgaatagcagtggttcgagtgatgtatgaatagttgctagcagtggaagattcttagcaccaaatgtatattctcatgtgcttcagaccacactctgtctctgccaccatcagcacatgcggcagttacgaaaagaaaagactgcagatgatggtgttgagcaatctgtatgcttccttctttactaacacacttgaattccttaccagatggcattagaaacatgtatcatttgtactgcaacctgcacacaaaagtctactgttgtgtgcataaaattcaaccctgcctagcaagagaaaattttcctgtcttctgttctctaggtgaagctttcgtacaaacatctatgaagcccttgggtattcttttgagaaagaagaaagctttcttgtacactaaaatattgtgtcttgtgtggagaaaaaagcagaatattacttggatttggagggaagagcgtgcagcttttacagtgtatgatctcttttactactggcatatctggaggaattggtggaggtactattcccaaaccaggcatcattggagttattggtggaattccagtcatcattccaagagcaggatcaaagtctaaaaaaggagaagagagaacaataaatgacaccaggcaaagttaagtggagatagaatgttactttgtaagcttcaaatcaaaggcctttctaagacagaggcaaaatatttaacaagcatggtacttagtattcccaggtcttaaatattatcttatagttgtgcattttcctttcaggatggggctgtttggtttgaccagggcttatttaagtctctgcatctcattgtggcatccaaggtctttcataggatggccatgccttgtctattgatcttgcctctcctagtttccaacacacactctctgctccattccgagaaggctttttactgtcccttgtacatgttttctttgtacggtacagcatgatattaagagcacagagttttggggatcaagcagacctgggttttaggtctaccatttgcttagcaggatgaacttccatttcctcatctgcaaaatagggttaatatcacctacgctacaggaagctgtgaggagtaaacaaaatgatgaatctaatatgctgagcataggtttgataaataactattctctgtgcctttgttcatgtttttctttctgcctggaattatttgggcctccgcaaattctccccatgcttcaaggcctggcttaagtgtcaccttccttgaagaggcttttccagataattctggttcattcttgactttgcctctaaaagctataggttctatacctgttaccactgattttttttttattttgcattattctttgtttaattcagggatgcctctagcatgtgtgggggcacccaaacaagtattttttgtggggcctatctacgtacatggtttgtttcactgcgaatcagtactggcagcattttcgtggcacaatctcacgcgataccatgaaagaaataccacaccagccagctggagtggtttccttgccaggccactctcctggaaccaagactttggggaggattccatgagtcctgaagcttcttggggcatctagttcactgcacatacaggttagaggattggatagtatcgcaaaggggagaaatggggactcaggtacacatgtgtcctgtttaagattggggcttctcagatgataatgccagtcacagtcagtcccagacactggaggggaacttagaaaatttcaagaaaggtacttcttacaaccagaatacaaggaggagctgctctggacccaggacagctgccctgatgatactgcctgcctggccagtgcttggctctggaaggggacttagaaattatccaggtaggcattccaaagcacaggggtccctgaggaggagccccacttgcctggatctaaggctggtattgatttcattgtttaaatcttgcctctaggtcaaaatggaatttctgtgagagaagggagtgcactttacttctttgtttctctgcctcccacttctgccttcgctatagaacctgcagactgcaaagaaagaaagtggactgcaaagaaagaaagtactgcagcctgaggggttctggtaatgcagaggcagttgcagcagcagtagcaggacttactcccaaagacttcaccatgttcaccacacaggccagaagagcaatgcctgtacacatgtccttaaagtggccctgaagtcccctgggtggctctttgtctctaagatgctggatgaggtcaacctaaatggcaggaaaaacccaggattcccacagaagcagaacctcaggtctgacaggcacaataagagggagatctggagctgggcaggcagatggcacatggacatcccctgttacaaaggcagcccaagcaagctagggcactacccagcctctcacatgcctttttatcctgtgatgtcaagaccctgaaaatgtttgggaagaaaaaaattctcccaagaggaagttttatttttatgaaaatatttacttttagccctcaaatgtcatctcactcaacttgcatgtacacacacacacacacacacatacacacacgtactctccccttccctccctcccacccatggctctcatatctatactctactctcctccatatagtagttatgtgatgttgaagaaagtttcttaatatctgtgtgcctccatttcctttttggtaaaagtggggggttaatatctgtatgcctctatttcctttttggtaaaagtgggggtaaataatggcatttagctcaaaggacgaaagcacagaacagatatgaagacctctggcgtgagagatagtactgataggtaagtttccttccttccatttaaaatgtgaaaactcacactgataaattcactaattgaggcattcattcacacattcacaaacatctgtgataggcttcctatatgtcaggctctatgcaagtgttgggggtggtgtctaggtttcccgtttgatcttagagaacttaaggcttccgataccctgtcttcctatgctgtaaaataagagcactatggttaagaatgccatttatgtcttcggaaaatttgatttctcatgcagaagattttggagaaattattaacattatcttacccatttacaaactgttatttttcgttaggaaaagatcagattagattgtgtgccaacaaaacaatcccatctatttttcctcttctactgaaatgtttgtcttccttctattgttctgcctgcctccttgttattcgtatagctctgtcactcacaactctaccttaccacagattacagaaacatcagctcattaaacaagttctgccactttggctgagaaggaaatgtctgtctccatttactgtctactaataaatggagacaaacaaaaaacaaatatacaggataaatataactcctgactgatgtacttaccactctgctgtttcgtataattacattaatattttataaattcatttaaaagcaaacgtattcattgcatatggctaaagccagagtagataaactccccctcttccttttgttcaatatgccaggagttccataggctacactgcccataagggcttcctagagggcaggttgtacatgacatttcaaaggcttctatcacgttgattatttcttttgtttatctttaaccattaagcaccaaagtgaatgtggatttccaatgtcaaccaagaaaaccatttgaagtcatgggctttatacatatattgcagaacctgaaaaatcaaagaattccagcaatttaaaacacactgggaatagaacaccagaggaattatctcccttttccaggcccctggcctggcttgtggagtactaccaagtatgtaccattgccacttatattaggaattcaaagtttcaaagatttgaaatcatataaaagagttatggaaaaggccaagatactcctccaaagtccttttcgcaataaatatcctgttctattttgcttttatcgtctcttctaacaccatttccccactgccttcttgactcttggcatggccattgctgaaagagccatgacatgttgatttgtattatctctctctgttttttttttttttttttgagacggagtcccgctctgttgcccaggctggagtggagtggtgcgatctcagctcattgcaacctccgcctcccgggttcaagcaattctcctgcctcagcctccctagtagctgggattacaggcatgcgctaccatacccggctatttttttttttttttgtatttttactagagaagcggtttcaccatgttggtcaggctggtctcaaacttctgacctcaagtgatccacttgccttggcctcccaaagtgtggggattacagcatgagccaccaggcccagcccgtattccctcttctgattcatgtacttcccaaagtcccagcccactggaaattctgcaaatgctgtctgttagctggggccagcttgctcctcagacttgcaactctaccatgtgatttcaagtaatgtttccatgtagctttgagccttcctgatacctagcaacttgcacttactcaaccttggcagagtgattattgtccattctctgtacacatctgagccaaggaattacaatggaggcaaatgtcatttctgtgcagctacccagttatccctatatctattcattcaatattttgatgacaggtcctatgtcaggtgttggggctgcagaaatgaataagacaaaaatccttggccttatactctagtttggaaacaaccacgcaaacagttacaatgctgtaccatcagtgaaccaccataactgtttattaagtgcttaaaatgttttaggttcagtgctaagcattttatataatcacattctaatagacctgtgagcttggatattgttatccttcattttatggataaagaagttgaggttcaaggggggtttagttacgtgctcaagtttatacagccagtaagaggcagacctagaattcaaatccaacttggtctaattctaatgcccttaaccactacactgcctctcaatgtagtatgacaatggtttcaatgaattaatatgattgcagatataaagtgaagcaaatatgttggaaaaaataaggcatatgagcaacaaaatgtttacatacaattcttcttcccccaatatggtggattaaagttggatataaattctttgattctccttccatcaaggtaagggtctatgcccctatccctttgaatctggatgggctctagaactgctttaaccaacagaatatggcagaagggatactgtgccctttttcaggcccaggcattaagagagatgcaatttctaccttttgtctctagaaatgtgtgatacaggagcttttcatcctcatggaaggctgactaccctgctagagagaccatgtggagagagacttagagcaaatgacagaagatggatccagctgagcccagtcttgtatctgtccttaccaaggtgccatgcatatgagtgaagtcttgaaatcagcctgccacaactgaggtatcccagttgatatcatatagaacagaaaaattgcccatctcagtcctacccaaattcctcaaccagaaaaatcttaaaatataataaaatgattgtgttttaagtcactaacttctaaggtagtttgttatatagcaatagataaggagaatatccagcatggctgcagtggaatgtgattggttaatagagttaacaattttcaaggaatgaaaatagaaagtacactaaacagccaaactagactgaccatgatttttctcagatttttgaaaaggcgctttgggatcctgcagggcacagagccactgtcttgggcaactgatgccactacactgttgctatatggaaggaccattgttcagttggaacaatgtcagatgactgacgttctactaggtgtactaagataacagttgtctaccaaaccgtagaaacctcagaggtgttctacatctgatgtctgacaaagacatcacacgtgcctattttatggttcagtcctaatagtttttggcaggcccgttcatgctggcttttcttttctttttttttttttttttttgagatggagtctcgctcttatcatccaagctggagggcaatggcatgatctcagctcactgcaacctctgcctcccgggttcaagcgattctcctgcctcagcctccctagtagctgggattacaagcacgcgccaatatgcccagctaatttttgtatttttagtagagatggggttttaccatgttggccaggctggtctcgaactcctgatctcaggctatcttcttgctgtaaaatgccaacttttacctttgtggtaggggagaggaatactagccactcattaattggctacttatgaatttccaggttttatacactgcatctgacttaatcttcacaacaatcctaagggatgggaaataatattccctattttacagatgaggaaactgaagctgaaagagataacacagtaaggatacacagtaagtagctcttactaaacgtgctcctaaccattagtctacactgcttcccacaaagtccacagtttcatagagaaagacagatgccctttgtcagatcagtatctacctactcaaccttgtacgtggccttcaaaccttcctatccaggaggctatcctggggttgcttatctctaaacccagaagttcctattgagatatttcacacatgcattgtcacagtgttttggggcctctttttaaaattcattgttgcaattttgtgccacaaaagaagttgaaattgtggccatgtatcaattggaggcaggcaaaggtaggaagtgacacacattgactatcttgcttacaattttcagaactggaccctggttcttactggaagcccctttacactctcagaaaggctttgcctgcacttaacgacttatccccatccaagctcccctggcccaataaaagcatttccaatcttttaggtgttccagagacccctgagccccaggaggtagtttttactcacagtaaaaccactgaaatgcaaccacagattattccaaaataactatttcaaataggatctaattatatatgcataattaagctattttatagaaagttatgatttcaattgagctacatatttctgagacattattgttatttctttacagttcctacaaaattcattggaaaattaagaattatgcctgtgtactgggaaattttaacccattacagtcctgcctcctttctacatagtttctttaaaagactttttaggcagtctttgtcagattaatatctacctactcaaccttatatctctcttctaatctgaagagagaacacagatttccaaggacagcctggctgagctgtaagatgattctggacttctcaccagccctcttggaggcacaagttcccaaatttttttacaatgactctcaaattctacctacatctgtcccgtttccccaaaagatcatctaaacacttgtttcagctcagctggaaaggtgagacagggcctggctcatgtacaacagcaaacaatctggcaaactgggattggtgggttatgtggcacaatttcagttcacaaaggtcctcccaaacatatctcaactttgatcccaaatttccaccagtggagctttattcctttagtgcaaagttttgcaaaatctccctctgtagcccatcttccctcaactcctttttattcatttacactgtgttcttgcctttttagaacatttgacaggtccagagtcatgccctccaaaggtattcacctttggaggggcattagtgaggacatttcccactacatctgtggttcccagatttctggattttggaaatgaataaaattatacccatatttaaggtcaccagcctcttaatttgacaagaaaataagtggggaaaaaataaaaagaaactaaaagaagattttaaaataaaaaatataggaagtctatcacctcagaataaagggcagtcctttcaattgagcaaatttagcttcatgacaaatttactgcatttttagtttttacattttgccataaacgggtcctggcctacacaccagtgtttgggcttttgagatcactcaaccatttcacttagtgtgctcccctatatatgaaacttcctgtgaaaaatttctttcagaactagaatgtcacacacacacacacattattaagggccattaaaagcttcacttcccctgaggactggtatattttttcttcatggaaaatgcaaattatataactgatcaggtttcccttttttgttttggctgctttgtcacaggggcagctcaacttcagaaatcaggtgggaatcctatgacctacacacctgaattttaattaacttccctacctggtctttgtcttctattctcatttatattttcccagatgctgatttattttatttttttataaattattgtattttttcatatactgtaatctttcttataagctgcctcaaagtctttgctgaatgaggtgatgtaactcaatagttaaccactgtctccatactgtatacccttgcataccttccaatcattgatgcactgtttcctctgcctacactgttcttagttctttcatcctcctgacatactcctatatatacctggacacctagctcaaacattacctcttttgtgaaccttctctgaccactgccatctacctagcatttcccctcaccacacctgggctaaaacaatacttatgtacaagtttctattatgacacttgcaacatgatagtgtagtggtatttactttgttgcttctgccactgcaacttgagcttgaaggcaaggattgtgccatgcccatattggaatcccctatatctagctcaatagattttcaatgaatggatggataaataacagaacaaatgaacaaaatgaaaggaaggcctttgagctgttgtcagtgaacagccagctcatattcgagaacatgttggattagggagagaatgggaaagttctaaaagtattggagtcactatgagggtaggaaactttgtctttcttgttcattgctctgtccgcggggcttctcacagtaccttcataccggcaggcttcagtgaatatttcttgtatgaatgaatgaataagcaaatagtttgactcagttctttctcctaatagtttccatggggagtcttttccttttctttttaaatgatttttcctatcactgtgcatttacttattccagctagttaacgtcatgaaattcttatctcaaagatcctctagcccttgagcttcatgtactcttccaaaggctttaaatagtttaaaatgtttccaagagaaaacagctccacagcatttacctacacagactgtgatgtcgagcgcctcactatctgtatttcttggtgtcttccttgggagataggacctcgttctttgtggggacctcaatacacagtctctattatgttgaccagctcctgtttgtccttctgtggcccagttaatcttgttgttgccagtaatcaagtcaaaatcatgatgtgcttgttcccaaataaaaatatgacaatacatagatcatataaactcatacatttttgttgaagtaaagtacttctgtaatatcaagataaataactacaacatttttaaccttttcagctatacaatacagaactcatgcatattcataaaagtagggtcccaattatgtccaaaccaaatgatgacgcctcggtctttttttttttaaaggatgacctgacacaacagctaactgccagctgttgtgttagtacaggagcgtggtggcatggaggagacttaaatgagtatctccaggtgtagatatgttccatggtgaatcttgagagtaccatcagtaggtagaattcaggtttgttttgaagagacattaattttatctggtatatataatgtttacgtattattggctcttggtaaaatatataccatgatgatgaacagtgctctcctttctcaggattgcaacttttttgccactaaaagcatactctatttgtggcagatattaaaaataatacaaaccgaagtccaggccttcctgaggagcttgcagaacagtggtctgtcatgtatcatacaaactccttctttctttctgttcccatcagagttggtctgttggatccagtgagaactgcctccttaagaatgagcagggctttgctctggaaataaggtccatgagtccatattttccaatatctttcattatggagcagacacagtcaatacagtggggacatcataatgagggactcttctctttttggacttcacaggctccacacttggctgctaaggatattttaattgaggggaaaataaaggaagcagcaggtagtattcagcaagtatcccttaatgggtccatccttggattcatctggaatgactggggcagaacaatgttctttaaccagagggcctgactctattgggttccactaacattagtcttatttgaccagcttctcaaagcaaatactcttgcaggaaagacagctgccagccagaggggacctcctgatctgccatcattatggattaactttattgaaccacagctgtacaaaacaccatgttagttgaaagggaactccacaccaaacctcagagatagcctgtttctactccctactcaatgaatataataattatgccagacattgccttcatgacaagtgtgtgtccaagagactcagcatccatgacagtatagattagaggtctctgggggaagtgaaggaagcttacattattgttagtttttcatcaatgtcaaaagacttttctattgtcacagacaggccagatgagacaggacaaagaaaagtcttctggctcagtaggaaacctcctgagaagcataaaagtagctgaattactgagcctttgatgggtgacttcaggcaacagctccatgaggcttatttgctgccttttccattttaagaaatcttgaggcatggggtgctgatcagggagatgttttaacccattgtaaagatggcaggcactctgttctccagaccttggcaagaagaaaggtagggagcattggagtgtcgtgccaaccttccatttctgtgaaaatctccaccagatttataaggaacaggcatcagcactgtcagacatatactgttctcttcacctgttgctgtccagtatttcaccaggcaaaaatttcacgcttgcatttgctgtccttcactattgttaaaggtaaagatgagtcataattcaactttttgtgagccacatcgcacatgtgaacttgaaacactaataacaatagctgagttaattgaggaattactgtgagccaggcatcattctaaggctttacatgtattaacacatgaatcctcataacaaccctacaacataggtgccgttattatctgcattttacagatgaagaaactgaggcatagagaagtgaagtaacttgtcaacggtcacacaactagttaatgacagagatttgaacataggcattctggatctagaacccaagttcaaatgtcaatggtaaactgccttcctaaaataatacagagatgagaaaaaaccagttcacacataacttaagtgattttatacatagctttacaaagtatatctcagcctgatgttattgccccatgcactttaagacaagaagggaactatttaactaataccagcatttccatgaccaggtttctaaagagtcaattaactttccctggagcatggtggcagcagaatcactgaattacatacaggtcaaagagaaaccatttctttacagtcgttaagaaaacaagatgtggagaagggggccaatggtagaaattaaaaatactcttgaggtttcaaacgtctggttgaagctggatgtgcagaacgctcattagcatattagcattgacagtggctccatagcatccaaatactttcaatttaagtgggagcttagcagcaatttgaagaatgtatgttagtacttcctctacatcaaagagcatatagtactgctaagagtagtaataatgatgacagtttatctttattgggtgcttattatatggtaagcagtgtgctaagtatattatttaatgtccacagtaatcctgtgagctaggacactatcattatctccattttacagatgagaaaactgaggaacagagaggtcaagtaacttgcttaagggtaacacagtaagtggcagagcaaggactcaaacccatgtaatcccctgacttcaaggcttgtgttgttaagcactaagcaagatactgttatgaggattcaagccctccaccacactgtttagaaaacttaccccaatcttctagccttattattgaccccagctcaagctttgggtctgtaatgattgcttggtggcatttttgttctcaatgctaggcctttcttttccatgttatagatggatggctaagtattgaatattactttgtgagcatagatttatgcttatatacgataacttacaaatcatatgatatcagttaacatttagtcccctggaacacagcgcagatgtggcctcaatatttttcctgggacttttacacatatggtccagactgtcataaactggaaatatttaagtcaaattagattgtctagtcatcttagactataagtgttgtgactcagggacactccacaatatatatttcagtttaaaacaatataaaacaatatatatttcatataaatatataaaacaatatatatttcagtttaaattctattataatcaaataataaagaggtactaaataaaaaactcgttacttccttagaaatgtctatgagaaatacattagtaatgatttttgaagtattttaatagctgccatttttgagtaccttctatgtaccagacattgtgctaagtatgatttaattgtcataacaatcctaggagttaggtactattagtctgactttgtagatgaggacactgggtctcagaagatacacaactgctcgagatccaatagtgaaagaaacaggcttggaagccaagcagactgaatccagaacctgacctcttaaccactctgcaatactggctcctacagtaacattcactgatcccagattggccctaccagtcattcaaaacttaaggagatccatggtccaatcacggtagctctcaaaggatgtttggttgttcatttcaattgttgttgttctaatggagaagaatacagtccagtgaactacaacctatggtatgaattatagtagtttggcagagttctttgcacctgccatatatagaatttagactccttttttttctccacccatttcttattcacatacctttttttcttcatgtttggttgcttttatgcttgtttcttggcttttgatgtaataacatttcttaattcattattagtattgctgtctagtggacctcaccctcattataacttataaggatttaaaacctaggctggaattgtgaaataatatttttgggggtgtagctaactatataaataaatggcaagacaaaatggcattactctaaatctgtttctcaaatttagtgtgcctgcgaagcacctggggaccttgcgaaaatgcagcttctgattcagtaggtctgtgctggggcctgagattctgggattctaagtggttcccaggttatgcagggcacactttgagtagcaaggttctagattggcctggtcctgttgtgcttttaagtaaagtcacaattaattgaatctggggagattaatgtttaggctgtttaaaaagctgcctcaggctccctgagatggcaattctcaaatgtcttcaaaaatttattgtaataattaattagctctcactgtccaggaagcttttttgtgtctaaacaaaaccctccaggtgctgtgatgttctgcttctcattttatcttcagcggagatggagttagtccaccatgtcaattctattatgggttactttgtttatgtatatatgtatgtgtgtgtgtatttacacacagttcttcaatgttaaaaagagtctttgggctgtcctccaccgtctcctttcctctcctctaggaatcttaagatcttggagatatctaagtcagttctcttcctgtctccatgtttatttgcctcctctatgaaatctataaaattacacacgctttgtaattccttgccaaaatcctgttgccttgtatttcaaagagctgtttaaagcttcaatgaccctagcctgcattggatatacacccagcatgtccaaagtgcaaaacggagtatactagtaactactggccacccagactataaagctcatattacaaaaatgcacactctaggcagaatctggtaaatgtcaacttcaaaataagttgtgtcatactgctatatttataaccacatggtcaataaaaataagcacttgcgaggtgattaaaaataacataccaggtaaaattggttgtccggcaattcccagcggtgccattccaagattattcattgctgtggcccatgcagttggatcagacataggtagtgtcattgcagtggaatccacgttcagagttctactgttatcggctgaaaagaaatgacaagcaaaataatttgttgtgttaaggttctagcaactagtttacttataaacataaattctggcaaactgtttatagaaatggctggagaaatggacaagtggtggataaggcctcaatgccagctttcttataagggttaaaacaacacagcttgaactggcaggaagtcatggaatttgaaagtaatttaccagatggcattttagtataagtgtttccttccttctctccctttcttccttctctctctctctctctctctctcttttttcaagcatacacaacagaggagcttggaatgattaagaagttttctattcttctcacagtctactagcatatgattacttcagcagcttccatccaaactacttatgcatgtaaagcaagaaaaaacatcctagggcttctgtagttggcaataaaagatgaaaattatactcctgatgtaatttcatatctttgaagcagtactattgaatagagctggacacacaatcagcagacatcaaattagctgaatgacaattttgggggttaggggaacaatgagaaaaagcagactagagacacagtccctgccctcaaaggttgtacaataaaattgaagagactgatgatgatggtgataattattaccattatcactgttatcaccacctccacccactactacctctgttgaacacttactgtatgccaggtaaatcacttggcatgcatcattctcatttaactttcagaacagccctatgaggtagggactatttatatctccatttaatagaagttttagagacatttaagagaagtttcgaaaggtcaaatatattgtccaaggtcatacagaatgtataatttttagccactatgctttactatctccagttaaacaactaggaaacaatgaaagactcaaatggtatagatcagaaatgttactgtagtttatggtatgcagagctactgtggcctgagtaagcaggaaatacttcatggagaaaataggacttgaaagaatggaccagatttatatagagcatgtcatgagtgatgagcagttattagataggtaaagtagaggggccagacatcccaggagcaggaatgatataagcaaaaacattgaaacgggttttataagcacgtacatgtacacagtgttgggagagatatagtcatgagtcatctgagcacaaacagactttcgttttgggaaattttcctctgactactgatagccatagaaaaatctttctatggcttttttcctacctcccagtacacacttctgccaattacaacccatgaaggcaactctgttctaatagtagcttgctaaagtccaaggcaacatcagggctgactcttgccagggttatgtatacatgtgctattttggtcactgattggtcagaacaagcaaatgtaaatgtctaaaaacattatttctgaaatattagtttttgtcatttttctgtgctgcctttgcctcttcccccttaatccctccttcacacacacacagtgattgatggcactaagtgttcattaattacagtcagaagtcacatttcagagtgattactcctacagagtgatttctccatctgtaggaactttagtagttatatccagctttcagtgttctctcacaaaggcatatccaaaggctagaaatagcctccttgcaaatattatcaagaaaacaaatatgggatgctgaatatcctttgggttgagagtttacatagtgataattagtctacttggacttccaagcccccagctaggggaggtaagtttttagagaatgttacagctgaaagatacctttagagattattgagtctacactctgattttctctggttgctggagaatcagtcccagaagaaactggtaggtttagaaggactgggacccaatgccaaaaataatttcttacaacagtttggctactcattggttctgcagtcatgagaaatattaaaacaaacaaacaaacaaacaggaacacttctcagtaaaggattttgaggtcaaagaatgagaatttataatatattaacctagccaaactctggactaattaggggcgggataagtgtttgggggaagacaatgatctcaattacaattttgaaggaaaacacagtattgttattttcaaaatgtatagtaattcacaatgcttgttaacatgttagtaagtagagttcctggtatgcttgtttacaggaacagataaggaacatgtgtgattaacaacattatttcatctcaatgaaagtggttcttaaattcttaggaagttttgctttaaatgtccttcttatctcccttccctcccctaacacccatctccacctgtcaaaatcccactcatttttgaagggtcacctcaaatgctaccttgtttatgaaactgaaatggccaggtgggaagggctccctggcagagcctcccactgacctgcaccctggggtggagccttggaagttcatgtgtttgcagtgggaaggagcctggcccctcctcttcctgggtggaacctgggattcaatctatgaggcgggaagcacaccagcaggactctggccttgcagagggtccccgtttcccttttttacccctttttctccaatacattccatttttctcacccttcaaagtgtctgcaagcctaatctctcatggccgtgtgacaagaacctggttctttgctgaactaaggaaaaagtcctataacaaaaccacctcattggaattaattacttcttctgatgtgttctcataacattttatctagaatttgattttcacatgtttgctcattctctcactcattccttgcaaactaaacttttttgagtcttactatatgccatgctgttttgctagtaactacgaacacagagatgaacaaaactcatttactgctctggaagaattcaaaaacaataaacaatccaatgtaaattattataataagtactgtaattaaaccatgagtggagtgctctgggaacacagaggagtaattaaagctgctgcaatgggtttgggtatacgtgtttctggttgtggggtggaggaggaatgccagggaagccttcattgggaaagaatcatttgaagtaagtctttaaggagggataggattttcttccaggtagtgaatggaagattggggtaagaagagcattctaaaaagcaagaagcaccaagcatttaccaccgactgccttggattattgttattgtgtacatgtctcccttctgctggcctgcatgcctcttttaggtcaggtactgggtttgaggcattttctttccttatttcttagtttagtgtctagtataaagtaggtattcaagaaatatttaaattaataaagaaaattaatttacattgattttgggcacaataagcagtctatacaatgacacccattgattatttgtataccttttcagaatgacaaattgtcttaaagaggtggcattattgctaagccaattctttctctaggacagctgaatacttgtagaaatttgcttagttacaaccagggatatatgcccaactaataactcagtttgatctcattagctatgatctttttcccatatcggcataatcatacataaaagcttgcaaaattttgctttcaaaggaaaatcccagatgatcacctctggcagtaatctggattcaaggtccacggtaacaaaacatgttgtgctaagtatctgtttagaattatcacttaatggtggaaaagttaagttctggcctgatccactttctagactagaaatggacatctagtaattttcccctgaatcctacaatcactggcagcagccaagaatattcagaaggcgaatgctactggttgtcaagtggtctttaaaatacctaccccaagtctgaagaacatgtcttgccatgctggttctcctattctgctgtgtgacaagttctcaagaggtcagagattgtagagtggctgtgagtaagtgccttctaggtaatttggttgaagatatggcactttggaataagctccattagcaccaaaagaatacaagatttggaagtgatcatctacttgaacttggtatcattttataactatcaaatctctgccatctgtttatttttgtattgttgatgcatcactaattaacttgtcaatcactgtcaaagttatttgattttgaagactacacacacacacacacacacacacacacacacacagacacacacacaatttcctctgaaacaaggacaacagtatgttggtgctgtctcttcaactatattctttcattaagacaaaaactctccttctctgatgatttactctcctacaattctctttcttatgtccgagtggatatccactggtttttatgctcactgtaattttgttacacattattatgcaaagttgaggagacagttttgtcaacaaacatctattgaaagcctgttaaccacaggaagcaatcctgtctaatcatcaagagcattggtctgggagtcagatggctctggactagagtctaactctactacttagcaactgtaatgtgctcattcactttctttcttctcttcttgcctgcctgccttccagtcttcctttcatatttaccatacattcactgaacattatctatgtgtcaggcagtattgcagatgttgaggatattagggtgagtcaaagagacctcatccttgctcttgtagaacttatactctaatgcaatagacagatattaaaatacaaataattatgcactgtaataagtgttatgagcaaataactgggtttgacgaaaaaatgggaagctactaaattaggaaaatgaaagcatctaccttataggtttgttgaagattagataatgtgggtaaagaatttagcatgtcttctggctcatattgagcgctcaataaatggccataataacatggtaatagttatggtaaacgatgaggaagtggtcccagccctcggggggttcaaagtctactgagagaaccaagcatacacatgaattactagaatacactgtatgaataatgaaactgaggcacagagagtttaagtgatcagctcaacatcacacagctagtaggtagtagagcaagaatataagcccagtcagctctgatgccaatgctcacaatgtaactcatcacactaaactctcttccaaagagtacatttattctgtgttctcttagctcactgaagacattgctatcatagcccttactacattatatttttctgatctttttccatgtctgtctctccccagaaattgcttattcctccttgttatttctagtgcctagacacagtgtctgacatagaaaagatgtttaacaagctattttaaacaaatacatgaggaaatatatgagtatacaaaagagtcctccacagatattctttccagaagcaggtgtcaagctattcagaacaggatactactctattattgtattaagataaaatctcttttggagggtttcttttgagggctgagtgttaaacaaaaattttaaatggaaaaagaaaggaagataaaatgatgacaatttgaagtattataatccttacatgctgataatacaaaaaattcccaattacagacatacaaacttcaaggaagataaatctggggatgagaagatagcatcactgagaaattcttcacttatgagaaggaactaaaatttcttagagaatttaaggtaattaaatttactaaaatgaaagtccatgtagcagccatatttgttaattccttgaggccaggcgacacaaacctcatttacttctgcaccctttactgtgactagctcaaagtaggtgccaataagtgtgtttttaaataagagaactctacaagaactcagcaactgtacaaagtggggcttacctgcatagcctatttcgtagacccacagccatctaaaatctctttgcattgtgtggtcctcaactgtgaacttagctctgtcatcatttctgcagaaagaagatagtagtctcagctgggcgtggtagctcatgcttgtaaatcccagcactttgggaggcggaggtgggtggatcatttgaggtcaggagttcaagaccagccaggtcaacatggtaaaacccaacgtctactaaaaatataaaaattagctaggcgtggtggtgtatgcctgtagtcccagctacttgggaggctgaggcacgagaatcacttgaacccagggatggaagttgcagtgagccgagatcacaccactacattccagcctgggcaacagagtgagactctgtctcaaaaaaaaaaaaaaaaaagaaaagaaaagaaaaagaaaaaagaaaaagaaacagatagtggtctaaaggtgggtgggacatgggacatcaggcctctagaatatactaggactcagaaaaatgatgaataatagttttttttttaatactttaagttctgggatacatgtgcgaatgtgcaggtttgttacataggtatacacgtgccatggtagtttgctgcacccatcaagccatcatctacattaggtatttctcctaatgctatccctctcctagccccccaccccctgacaggccctggtgtgtgatgttcccctccctgtgtccatgtgttctcattgttcaactcccacttatgagtgagaacatatggtatttggttttcttaatagttttaaagatagcaattataataagactaataagagtcaacagttatataatgcttactatgcacctcacactgttctaggcactttatgtatattaatttaaaattcacaacaatcctatgaagtaggtcctttcattatccccattttactgatgaggtaataggaacagagaagttaagcaagctatccatagttatatagctagcttgcagtagagccgagattcaaacccaggcagtctggcttcaaaattcatgctcttgaccactatgccctactaaactagggggttcatcaagttatagaatatttgagctgagggctctagagctcatcattatacagatgggtactctcaatgtcctctattgcagtgccaagtttgccccacaggggacatttggcagtatctggagacatttttgattgtcatacctggcagcaggtagttgctactgacatctagtagaggccaggggttctgctaaacatcctacaatgtacaggacatcccccttcaagaaccaattatctggcctaaaatgtcaatagtgctgaggttgagaaatcctgctctactgtaacaatttttgtgtgttcttactggagaacgccttatacccctggtttcttccataatcctttcccatctatcacatgtataggcaactccaacttctgtagtttatgccgtaccctactctcttatgctatcgtgcaactaagactaatctgatcaaaccctcctctctgaccccatctcaagaatctattaacgctttcagcatggttacttctatgcttcacatcaaagaaatgatccttgttgtgggaagtccaggtaccatggaatgctcatgggttgctgtttgagaatagtcctggaaatagcagtaggcacaccatgacaaaggaaagagaaaggaagtttagaaaatgcttgaacaaaacgtggaagaaaacttcatttctggcatatcacataggacctcgcatatagtaggcattcgagaagtatttgttgtgaaaagatgacacaggggcagggttgggtgtcctaccaaggaataacattgtgttttctgttctctgtctaagggaaaggaaacagtagaacaaatcacatttggggtctgcattaagcctggggctcaaggctttatcttttgcgtagtatttattgcttatgaagcaatatattgtggcagtgcaggtgttattttgaatctctcttcatattccttgaaaattaacaatctatcattgtttgtgaacaatgcactgaagcctgaggcacaggccacagtccctcctattgcagacttcaagtgatgccacagcttgcatcacggtgatgcaggtgagagaactgacaggggcttttgtaggcttttgtaatacaaggctcccagatggcttgagagagatgatgctattagacaagcaggatggatcaaagagtcactcaagggaatcaagatgtcatacattctcttccttgagaaaggaaaaggagataagggaagggaaggcaaagggaggcaagggaagggtctttatgctggcctatatatatagtaggtagtcattttcacatgagttgtgagtgtggcagggtgggagttggaagagaatagcttgatcttcaaggtatacagatgagaatctcagcatagcgggtgctttcacaaactaaacctcatcctggaagatttattgttttagtctataagctagagggtcctgaagacagccacctctgtattggagcagttatcaagatgttcaatatttaagttagatcaatttaaagccacagagccaggccagccctccagatggcaattgtagtgagggtggggtgagggcgtggtatagtgaggaagaagaaggccacagaatttggtatgtgcctctccaaggaagtgatagcacataccctacatttatgaaggcaacaaggtataatagaaggaatacaggacttggagccagatagatctaaaatccaaccttggctgtactcctgactagctgaatgactttaggcaagttccacaaactttttaacctgtttattcacttgcagctggggataatgatacctatctttcatataaaagataatgataatgatgttgattcctaatattggttaaatgcttattatgtgctaaacattgttttaaagctttgcatgtattattacagtaagtagctagccaggcatgagtggggcaggagagggctcccccagccccaccaggaatgtcaggcgactatcaggtagttgtcacactgactctctaaaatagtaattgatcatagccagcgccaggaaaaagtagtttcccaataaataaaaacacctgaaactggtgattggcagcatcccaataagatctctggtattgggcaagtgggctcaggcatgtgcattaagagacaaaatggcacagttgaactgatatatgaccttccaggggcattccactggaacagggaagaacgcttcagatgagcatgtgtacaactctagtaaacacactgagcatgctcacctcccaagtgctagcaggcccccacacatgcaggcagcttaccctaatggaagaatcaagggaaacgggatgcaagatgctggaagtatgccagcatataaaaccctaggtccaaagtcaaacagggcacttgacctccaagatatccacttagacctcttccaagtgtactttaccctcttttcattcctgctctaaagctttttaataaactttcactactactaaaacttgccttggtctctccttcttccttatgcccctcagtcgaattctttcttctgaggaggcaagaactgaggttgctgcagacctgtatggatttgccacaggtaactcagatacttccaccactaacagtattatacaatataattcttacaaaaactctatgagacaagtgatatttatcattatactcattttatagacaaggagtatgaaacacaaagaagttaacaagtggcttaaggccacagatacagttaatgttggaattggaattcaaattcaggaagtatggctccagagacaacacgtttaaccactgggctatataccatcactaagaatgctgagcccaatatctgacacagagcaagtacctgatcatgactttaaccctacttcctttatctttcccttccctttttctggcaaggaagaaatcattcagatgccctgtggggatctttgagctgcggccaagggcttcttttgtaatttcagggtgggctggcatgggctgaggtatctcagggatagtacttttcagttccaggttattaggcaaattgagtcagaagaataggttaaggttggacccaggggttctggttggacccagggttctggaataccatcaggctccactgtgggaaccttagagggctgcctcagctactaagagcagtggctgactccccttgagaggctcttttggggtttttctggactacagtctgtaattgccaaccctctggcttcatggacttctcagatacctgtgaactaatgttaccttggtctagagtgaatggctgactatggtcctctaatctaggattacatcatcacatttattccatattttcttacctaatatttaggtaaagaacaccaaaaagcatagatgggcctaaaaaaaaaatgctacctgtctcagctcctttaatatctgcactaattgcctgttaagtcatataattcttttcctggttttgaaataaacacataaatattactgtcaggaccccaaatgttgtagttactggtgttcaactagaaatcttaatatttaaactaatcaactaactgcatttcaggtactgagcacgctctttaagttaatggcatagctgctggtgggggagggggtggagaaagaaaaaaacagaagcataaactttgttaagttcccaaagctctgtggtctgtgctttcccaaggtaagttgagtaaaaggtgacttggcaacactgctaccatgctcttggaagtctggcaagatctcttggaggaaaaaaaaccccacatcagtcctggggctaatccacaagccgttttgctgcagtccttgttgctgaaaatctttccaatatgtttcagtccacttccttgccatagaaaatagagtatgacaaggataaatatagcatgaacaagatctggagtttggaaggctagtttgaactctggccctaccgtttactcaccatgtagcaatcacttacacctgtgtttgtcaaagtacgttccaaccatgtgcatcagaatcaccttgggtgcttgctaaataggccaatttccagggttcactgctaaagttttcacctgggtggcactggggactctgcctgttgaacaagtaccctaggtaactcttacacccactacaaatttgagaaacacagagcttcagttttcttatttataaataagaatgatgccaccctttcacagggtggtggtgaaaacaacataggtaatcaatatgtgctagttgtacctgaatctttggtgaagttattgcaagactacgagatacattctgaatattaatttaacaaacttgtgaaagccatatattatgtgatggtacccaggtgaaaactacatgttttcctgtcctttgaggggctcatagactagtgagagtggcagatatgaaaacaaaaactactgtacggtttgaaaatggctaaacagagatatgaagaagggggagacagttcccctgctaggacggtgctaaggagagaaggtggtggaggagggaggggagcactgaggaagtgatgtgaagctggaggtagtgactttaaactgagttttgaaaactaagccaattatcatggtactacaaatatcttaaaaggtacagaacaaggctgtatttgtactaagtctaaaacctagaatgcaagttgttcttgtttggggaaatgggagtgagtggagaatattttccatatcaatttccttatcatttctctctcctaaaagtagaatgtggaacaactggagtcattttgtattcccagtaggttgactctgagaggatgggtgttgggctatattgttgacttgctgtgtaagtcattaactacatggccatggtctaagttggtgggggtagggggtgggaccctggccatgatgactataaataagtcaggtggtaaatcctgctaataatgggacctttggctgaagtactagctgcctcagcagggccatcctcagatattaagggcaatgctatatatacacatacaaccgcatgaggcagtgactaatggctctgccttgggccagcagctctggcccctttcgtgcttctttacctctgcaaagcagccaaactggagttttcaaactccactccaatttgacaaataatcaaaagacaatagactttattatacataccttcacattatcttcactacccttcatgtttcaaaatgactgtttttttttttttgaaaaccacaacacattcccatcaaccactagcatgcatttggccagaccaggcatgataaactctcaagccttaatgctgaacgatgctgaatgaagagaaaaacaagtagggttataacagtggttaagatcataatctttggattagatctgagttctagtcctggcccaacatttattacctgtgtgatgttaggcaagtgatttcatgtctctgtgcttcattttctacatctgagaaatgggataataatagtacccatcttatagagctatagtgaagattaaaggagaaaatatacaaaacagatctattgtggtgcctaacttagtaaatgcttgtagaatactagtaattattatcaatatactaacaatggtgggcattacctctgatatcttatggaaaacaggggccactgggggtaaggaaagaggggagtgttacaatttcttcaggtgaaaagaacatgaaaataccagtacaggaaccagccattaataatattagattggtgcaaaagtaattatggttttgtgattaaaagtcatggcaaaaatggcaattacttttgcaccaacctaataggagagaatgtatttacaacaaaaaaaggacaagatggtttatctttaacaagttctttaccaagaacactgccagaaaaaaacagtgggattaatttgtattcttctcatctgattaatgcattttctgaaagtgctactgctaataaaatcctaaaaagatgttccagtgttaccctccaccactgtacatacccccaacctatcagacctgctgccaaaacctatttgcttttttcctctaaaaccatggatgacatttgtatctgtgctctctctcctgatccccccatctgtggtggaggaaagccagaattacttagtgttgtagctcaattatccatgacaagattggaaagcaagggggtaggcaggagaagaacctgctcttcacagacagctttctaacaagacaaaggcagattatggccacggctgtgacctccatgacagctgggcacaggacacccgctgtatcggcatactccaggaacaatacacatgcaagtaaatttggttggcagtttgtgattctgggacagtattaataatagtgcctttcctgaaatctatcctgtatatgatatattttgccacgtttaattcaatagctcttctgaatattttaatacagcaacagtagtccaaatagcaaacacatgtgagttattaactttcttttatccatttctgctgtaacttaaattttcttcctgagtgaatctccaggccactagtgacatcacctttaatctatttgtgtggtgtgtgtgtgtgtttattggcattaacatggaggagacataagctgttaaaaaataaaaggcgtctaggctagtgatgatctccagagtaaaccttacagggattggcagagcaaatttgatttgaaaatgattacaaagggtgaattccctgtaaataatgaattggaaagaaaatcaggctgggagtatttgcttatccacttatttccacatggaagaaaagctgtaattcctgacagcctgtgcttacagtgtgactagattggccagagagaaaccaacgggtgataaaaataagtacacaaccccaccagttcattgcattctctgtcagttccaacaccaaggaaaaccataaagataataagtctttggataacagcccataaatccatggttacagttcaagcacttaacttcaaattcccaagtgaccatgccactgttcttatctgttaaagaagctagaagttcactgtcagaaaggaggtgaggtgatgggcaaggcagctgaaatactcaaagaccccagcaaaattctgggaaagcatgccctccttgcaaatcaccacttcttgagaaactaactcatatgtcactgggagacactgtcagagccaactggctaggtttctaccaaagtgcacctagttttcaagagtggctatcttccttgaaaatgtaaagctaatttctgtatatcaaatcctatttttttccactgactcacagtgtctttttctaatttttaaaattacatattgagtaggtacacaggaaaatttataagatacaagcgtaaagtataaacaacaacaatgcaatgaaatttgtatgcccaacatgcagtttaagaaaaagaatatcactattacctttaaagtccaccatgtacccctccctaatcgcttccatctcccctgaaagataaccaccgttttcaattttgtgttaataattccttgcttatctttataattctactacatatgttgataccgtctcttcaaaaatgttttatcttaatttctaaaggattctttaattgccaagagctttctgtgctgttttctttcatactcctgccccaccgtttccctctccctcccctccctctcttcctccttctctctctctttctctatctaccttcctttctgtgtctccctcaccacccctcctccactcagctagaggagtagttagtgatctaggaacaaacatgaatgccaaagatatcagttagcagtgaatccgtatgtaaaggcagtaattattttgtaacatggtgactttccttttgttctttaaatgaatccctgcatgggccctaattcgtttacccagaagttcagaggtgattagggaatatggaggtggcagcaggctacagagcagggtgacggagctgtgagtattgcctagcatgggtacctcaggggtctggagccagaagaccatgctatttgctggctatgtaacttaggcgagtcacttaatatttctgggcctgggttccttcatcacaaaaaatgtagaaaacagtaatactgatcttacagggttgatgagataaacaagggatattaattggaaaagtattttgaaagctataaaatactatataaaggtgagtaaacgatgttgctgttctgctgctgttgatgacatcagttctattaaagtcaaggtaaacaactaaatggttatgaattttctaagtttggagctaatccacagatttatccttgccagctgcctggtaaagccagcatatcacagataaaattaaaccttcttttccgatgctttattactggtccatgtggaagcttccccccgcatcccccgacttcaaacatcttccccaaatcccactgtacctgcccaatctgcatgtgagggagttgtgtttgctctggtctacgtcagtgccggagcccagggcagaaagtagtcacacattataggaatgcaacattttctcttcctaatcatttctcataggacagtgcaggttggtaactcaaatcgaaatgtatgcaagatgtgctcatcacctgatcagtttgcgcctgaggaaccttctgaaggtcctgacttttgcctgtgtgctattaacataaccatttgcatgtcatttccattctgttttttaaagggtctctccttgaagatctatgagaatgagagtaagcagtggacagccacgtttccattctgcaaacgatataaccaaatctgtaaatgcgcaaaaatacacacaagagacgctccataaagctgctggcaattattttggtgaacagacgcaagttgtgcacaattccccacagctgcctcaggtgttgaaggaagagattcaaacaacagagggggaaatattgatcatctttttgaatatagagttaggctacctgcttaggtgcccaggagggggtgtgagagaaagaatgctggtaatgttcccacacgtttcccagcttgaggctggacagccacatgcccatctgctgctaagaaaaaaaaaaaaaaaaaaaccagacagggcttaaacacatacgaaaggctgtttgacctttcaggttgtaaggctcttgccctccgcctaacagctgacgcctggaacaagcaggcaaaccccacatggcctctgaaggggctagcatgggggctccagctgaggggcggctgcagctatggcaacacatgcctgggaatgagttaacaccagccaaaggggttaatggaagaggcaagagcttttatacaaatgcattagggaaagaaatgcaatacagtgggaatgaggtccattaataaagctgagtgataaaatccacgaccattctcaaattggacttggcaacttaaactccttttccaaattagggtcctgtgttctagctgctcatggggatactaagcttctatctttaaaaagaataaaaacaatactataatatgcagttaaaaggagaaaataggataggcaaaagggtaaaaattagacttgcaaacaaaggaaggaagagaaacaaaagagatgtgtacaactatgttctgaatatgttcaaacagcttgttattactaacaatcaccacctgacaataaattacccctctacatgtggattaaaagctgcattattatgatgcattagaatcaatctgagtactaacgataatgggtggcttggtggctaaacatggcccccaattactgccaagtgccctctccctttgtggctacaaaacaactgtcatcaatattctctcatagagagtgttttcttatcagtattacatcctcaaacatccttggaaagcaggtcgatattgatgggcttttctgaggaaaacagggaggcatggagaggttaagtgaaaatcagcagaggcagccctcctggcccatcaaagaatttgggttataaagggagctaaggtaaggaagcaaaggccttcagcctgctctttccatgatggcagcacctatggaatgcaatgggtcagggtttttactcaccctctcggctgtagtgaaaagcatataatccttaagccactgcatttagaaaatctgattgtagcttgcagcacagacccacagaagacatgtttacttctggcagagtccaatacaagcttagagtaaaagcttacttctgagaagaaaaaaagagtacatctcagttcagaaacagtataatccaccaggggtaatattttctagttacaaatgaactaacagatactgactgagcccctgttgtgctatttgttaatggctgagagggacacaggagaagcagaggactctgagaagactgaagctctttcctcagagagcttagcatctacttgtggttgggtgtagacaaattcacacacaaaataaagaccaaacaagcctctacagaagtcccaagtatagagcgacaagtctggtttggcatactggttagaggaaaagatgggatgtcggcacattcccgcatgaatgttaccagtaagacttacactgccaagcatattagacatttccatcagcagtaaatgcactcacaacaggggtgaccaagggagatgaacaggaggaaactgaggtaaatcagaaggacagatgtcgttaaagggaaccaggagggaggtgtctgccattatctgaatacgatcgtgtcatttttgaaccaaactccaccgacagggcctgcttccctgggtacagtgcttttcaggcaagtactcttggttggcatgtccctatatacatctaagaactagagggcaactgatttaagattgagtgctctagtgagcacacagaaggcagataatctgtgttgtgggctgaagagagcgagtcacatattttagctattaagacatacaaagtggtcaagctgtcattctgtttcagaaattaaggcatttgacttgtgtgcctgtccagatggagtgttattccactcatagtatatctgcagggagggcttgaactttccttcaaaaagcattttggatcattttagcatctttgctagggttcacagtgtcccagatgatgccttcttgagacaacttcacttcccattctcctctgctccacagccacaggttacagacctcactttgccttgtcttgcaaacattactggctataggagactcgggcagagggtgtggatggctttagagaactctaccactgcacacacacactgtcctggacacagtggggcagcactgttactgtcacaggtgaaactgatctttgtaatgagcaacagcctacagagcttctggtgacgtacttgtaaatttcccattgtgaataataaaattcagaattgcaagctgattgcatttctttctataggacctattctctggaacagaaaattggcaattgctatctctttttcagacatttgaaaaagacaacaattatgcctaaaggaactatcatgctataagaagtctgtttgtgatcccagcccctatagattcaaggaattttaaccctaataataatctagatgcgactttatagtgtaagagtccatctttggatttttccaggagtataaatggcacattattacatgactgttacttgtagaacttgaactgataagtatatcagacacatacatcaggagcgcatgaactcacaacagggttggtcaaagggggtgagctggaacgagagagcctgtggtaaattaggaagacagatgaaggttaaagggaaccaggatggaggtgtctgccattatctgaatatgaatatgtcttttttcagccaaacttcggtgataggccttgcttccccaggggcagcatttctcagagaagcaagcttagaagtcatttgggaagaaatatttctttattctgacatgagcagcttggtagaaaagatgagcagacatttgctttgggagcaagaggtgctaagcttaatgcccatcatctcctagaaatggtgatgtattgtatatacacatggaatgtctgcagctgcttgctatttcctggaggtcagagtacgcaaccttttatctctaaatatctggttttcaatctggctgtatcttgaaatctgtcttgaatacagctcagaaaggaaggttttggttaagcatgtagttactaaccttcaagcacaacagaatgccaggagagcagcctgacctttgcagtaaaattaatttgatgcttacaatctaacctagagtccatagcctttattcatatgacagagtcacaggacaatttagcggggattattaaattccacctaagctcatcagaggagagaattgaggttgatgcatatctggaattaccagtgaattcgccaaaccacgtggggaaaggaaaggcagatagacttctaggaataaagataaggggctacacttggtatgtagtaggtactcaatgagaactgattcagtgaatgaggcaaaagagtaagctgaatctgctgtctgacaactagagagacccttccttacacccacaggtgcaacttcaatccctatgagcttcccatacagcgaagtcacttggcaagtgccagagatcccaaggtgaggatggagggtgagtgggttgggtatggtacaagacatgccatccttctgcattacccttcccattccagttggtggtaggaagtctggggcaggacattgttattcagaaacaaagaaagctaatggataccaatgaatcaggagggatgcattttactcgaagtggctaagagaacctcaacagaagaactttgttgggtttccagaaagcctttgcgacagtactaccaactacagcactacccagggggaatcagtgttccagtcactgcacttaaacaagcatgttatacacaaaagcctaagactgtttgcagtgggaaatcctggttggttttatttaggcaatatagtaatgtagctttctgaatctgatgttctttatttgaacattcattatgatgattcatctctgcttttctttctttaccaatgatatttgcattctactaggaaatataattcataaaggatgataaaggaatcaaaattatccaatttatttccatcaaaggagcagaaggaatccagcaatgatctgttctgcatcattctgttttcagtacgtttttctttaagtcagggtttgtagcattaaatattactcttcattgcagaatcagtactaatttaacatcacaaggataatctggttttgtctaagggacccctccccattttgtttcccaggaactgaacattttccactccggatgttctcttgtaccatagaaagtattctgactctgtacctctctaagagatacgtagcactaatgtgactctctaaatgcctattagcattttaccttgtattaatagctaaccgggcacccttgctattttccctgctgagatgtatcaataaaaactttgatggcagggatgacgcctaatatactgtcaaattacccgtccccccgcaggatatggcatagtgaatgtacaaatagccaacataactctatcagtttttgtcttcttcaatctgctgacagtattgtaacacctgacaataattgcagttcacactatttgttggtattttttaaagtggaaaggctttccttaacttttataaaaattgtcctcaagttaatcttgctaatgtcttccatactaatttttttcttttgccaactgaactcagcctatatgagagcaataaaatctactagggatcctctggtgagctggttgattctgcctataaaaatggccttaagtcatagagataatatcggggaatcaggaatgatgttcaaaatattcaaacaccagcatggcatgggcaaccaaacagaactgtatgcaaaaccttagtactggagcagagcctgggagaccctcttgctgtgccatgtgggcatgtatgtcggagcgatgctgtgaatctccagccactattttcactgtggattccacaggcatcaatcctacccatggagcctgtgctttgcaaggaaatctcacaagggaaaggactttgctttgttagagagctctttatattgcagttgaagagaggtaaaggagttgtttctggggtatttccttggaacttgcaaataaagacttgtggtgggttctgcctccaagctattggaagagactgactagacagttacaggcttctccattttcatgcctacttctgcctcctgctaagttgcatcagtttcaaacacaaaggttaagatgtgttacctgggttaagatgtcttagccaggggtcaatccatgactattacactgtggggaagtctaggtgatactagagggatcagggtggcctgggtgacaggtgatcacttagagggctcctgacagtgcttatttaccaactggtacagaagtttttcagtatctttaaactggtatgactgtccagtgcatattggctgactatcagcctgaagagacctacttttcaccagaacaggcagcaaaagtaagcagatcctcctacccatagctgcagtctccttaaaaaatctgcctcagggttcaaggaaatctttgtgatccaagttatctcttatactaacccgaatgcaaaaacctttcctatagaaatattaacatactccccttattctgtcttcccagggatatgaacttctaatcactttttaatctgttaaacatgttttttttctttaaagaaactattatttaaaattgcttcccagtcatttttgagcctaaaaacaggtcccactatctattgcttttccagtccttgcaataattgagtcgagcatggatagctgagaagtagaatgagcagctctccttgctgtcttctgcttgagtgaagaaagcaaaaaattttgtaaaatggcagaggcaggataacatggagctctcccttcaaaccattagaagcaacagaaataaaagtgccatgtttttgtgccctttaacaatcatttttttattctagtcccatatccgggtccctgggtgacagacctaccccacctcaacatgcatgggctggctgcatgtagttatcttgttctctttccacacctgcacatgtctattcaatggggctgtgttacaatcaatagcaaatacttatctgctgggagactgactgagttccaagaccttggttcacgtaaggctgtctttgccatctagtgttaagttttgtttgcaggattactagtgaaatttctcaggaagctggataggacatatgggaaactgccaaggtgagtaattcctgcatctctagaggtgatagctacagcaacagtagcttattgtgagtagacaccagttgcaaagctccttaggcacaggctgggtaaaggggtgaactggaataataatttctgtctagatggaatgtctaagcaacaacattgagcatgaagtgttcatcataccctagtgctgggaagtcaaatcctagattcttgcttagtgataacatcatttgacaaagtaggaattcacacaaatatatgtttaaaagaaaagaccaggaacatcgtatataccttactgtctggagtatctctcaggttggacgctagacaaacaaaagaacttggaatacacatgaacaaacagtttcagatggcatgttacatagtagctcagaggcagaacccacaagtctttatttgcgagttccaaggaaacatcccaggaacaactcctttacctctcttcaagtgcaatataaagagctctccaacaaagcaaagccctttcccttatgagatttccttgtaaagcagaggctccatgggtaggattgatgacaatggaatccacagtgaaagtaatggctggggatacacagtatcaccctgatatgcatgcccagtggaagagactgaccagacagttacaggcttcttcaattttcacgcatactgctgcttcctgctaagttgcatcagtttcaaatacaaaggttaagatgtcttacctggggatttcacttatgcaatagatgagccaaacatatatacgagtacaaatggctgcttgtgaagtacctgaagtttttccgataaaggaggaatttggatgtgttacttggcctgcactctgccaggggcatatcgtgctgacattagaaaaacatgctcttttcaacaagatttagtctcacttccctttgcctcctggtctcttgctaatgactggaagtagaatgagagttcgattttacgatgatttagaggtctgtgagttggctttctccctttggtatgtgaccaacttcaaagaagcaattgtgtaactactaaggaaattagttctcttccaagggatagagatcttttgtcataagtgagaatgagtaactaagctctctgactctttctcaagagggcccctgggctgaagagggcctggctcgtggtctaggtttgctcactggagcagcaggcagtcagatggtcaaaaaatattgcttgtattccttttgtaggcagaagcactggagtagggaggtgaggctgggtgaagggaagacaacaggaataagacagtaagtaaatgaacagatgtaaagtatatagcacaatgcctaatgggcatacctctttatatagcttccactttttgaacacctcctctgtgttaactactaaaataagcactatgcatttaatcctcacaacaacattatgagacaggtattactaatattcttattttatgggggagcaaaccgagccacagaagtttaagtaaattgctcagaggcttcagaaatagtaaaagatggggtcaagatttgaagtcagatttctttcttttggccctaggtatcaggctttgtgtttgatatattactaacgccaaatcctcataccattcttgagttgtgggtgtgattatctccaattacagttgaagagatgaaggttcaacgtgattaagcaacttgtccaagatcatacaggcagtaagtggtagaatgagaattctaatccaagcctgaccccaaagcccatgctcttaaccacaaaactctgtgacctcttttgcaatctgacatattttagacagtcttcaaatgtttgtccccatctcaaatggtacagtgaaggtagatggaagacaaagagttgaaggtaacttagactcggtagtcagagcaggaaaggttgcagagttgagctggaatcacatcttctgttttctcttggggctggtgttgagcaggatgtagttagaggtgataaaagacaatgaggcaagaagcaactgatttctatcccctcatctccaaattataagaggaagagagatcactcagaatacgagctagggctaggcaataacactattagagagttactattacctgaggactattacctgagctatgtaggtgtgctagttatcaatctaatacctcttagctccaaattcacccttgttgcctgctctgtgaaaatggttctgggccctttatatatttttcctttgccagctggcacaatgttaagctttgtcagtagagggcgttagggagacatttcaggaggaaggggcttttctttgtgggtcctgtgtgctggtgtgctaggtgtgctcacttggcaggttcctgtagttcaggctttcagcttccccagggcccagttcccacagcacacacagctccccaagcaccaggttcctgcagcatgtgcaatttttcaagcatgcagctctggtagtataatcagcagtgcccagcagcttctcccagtacccatccctcaggatgtttcatggtggggtgcctattgtgagatacctctctgtgaccagctttccctgacactatagagggtggatttcccagaagttccacagggcagaattccagcaagttctgctgatgtagtaccacagcaatttctctgctatttaatgagtcatgactgtgcccttgtcctgcaagatatggatctcagccctggggaaaaggttctctcctgggtgccctagttcagctctaggtgtaggggctgctccttatatttgttagtcctatattctttgtagttgtttttacttcttactggccaatcccctgttatagttaatatttatattaaaatttttctgttcaaattactgtgtgatttctctctcctgatgttttccagacatatagggttaattcctcttcctgcatctcaacattctgtaaggtgatgactagggcaaagggatacttctagggatacctacattcgtaggtagggaggatggacttttcctagagacaaggtccaaagagaaaagagcattttctttttcaggaggtaaaagatgacttctctgtcttgctttttaatatacaaaaatgagttagaacacgtgtggcctttcacttgctcaatttttttcaatgaggaggaaagaacctgttagataggaaaggaaactgaagtctgtggactgcgtggattgtgagactcaaaggactcatgatcattcagagtttaaacagtgcttaaagctctatagcccaggtattccaagggggaagtgactacttgtgatgatagccttcaaatgactaccatctttaatataatgaccaatattgtactcaatacctctatgactacccatacaacccttactcaaagctcaaggttatatcccctcctctgcaagagatcaaatgttttctttgcttaaaattttgcttttccatggacatatgtatagaaattttcagacatcataaaattcatgaattctggaaaaagcttctgaatcctcagggtagaagtttggggtttagagtttgcacatcaggatgttttccaaatatcactaagagaaatgattttcacaagtgcagaataccatcataatttttatattactcatggatttatgcagctgagttccttttgaatttgagtaaaatattttccaaaacacttgttgttaattaactactacctttctaccgtgactattttttttgcttcctgcctccaaccagctcaaagtataatactgtctctccaaagctcaatgactaagaaatggaaggcaagtagttaaataggagataatatggaaacgtaaatttcaaggtctgatcatcaactaaaatgctccctatcataatacaaattcatctttgtgatatttatgaagcattggctcacaacaaattcagaaatactaaaagcgtcacagctaatcagatggcctgctcaatcactagaaagtttctaacatacacttcccatgtgctagaaccctcatagcaataacaacagcattggaggccatagcagctttcgataaagaatgtttagccaaagtggcctggaatacctatggtctttgagaggcttccacgtggtcctccagatcatccaaggtattgtgtgttcatgtgtgggtgaaggtcccaatcaacacaggtgaaagagagaagtctgagccacagggtacgattctcctgctagaaaaccagtcaattaaagtttcagaaaatcggtccaactatagtctctgtttcccttcctgtgtttgctcctccaaattttggttctggcccaagttcttagatgccttcactagccttccctttgtcactctgtcctccacatatacgcacatgtatatacacagagggatcatataaccaagaatagaatgggaaaaggagcattgtttcagagcagtctgatgttttatactgcagtagctggtggggacaggtggaagtgacatgtagaaatttgttgctccagttagaacttcctaaagaataagaagaccattgatattaaccaggagttgctgtgaaccaatgcagacctgccttcatgttcagaacagaaaccagtcctatgttgctgccattataatgattgtagattagagcactagtttttacccagggtggttggatggtctggcacataaagaactggtactgacaggaggagaagcctagtgtttaagatgggcctgtaaatcaaaaagcatctgagacaagtctcaatcaatttagaaagatcctttgccaaggttaaggatgcacctgtgacacagcttcaggaggtcctgatggcatgtgctgaaggtggtcagggaacagcttgcttttatacattttagggagacataatacatcaatcaatacatgcaagattgacattggtttgatctggaagggcaggacaactcgaagtggtggggggcagagggtgggatggggggaatggggggcttccaggtcacaggtagatttaaatatattctgattggcaattggttgaaaaagttatcaatagaaaggaatgtctgggttatgataaggagttgtggagacctaggttagagagaatagactgtaactgtttcttatcagacttaaggtctgtgttgatgttaatgctggaggggtataatgaggcatgtccaacccctactactgtcatggcctgaacctgtatttcaggttaaattttagggtgccctggctgaggagggatacattcagatggttgaagggggcactggaattttatttttggtttacaggcctaaggatcaagacctgggtttgattatcagattccccctatcaatgagcaaggtacttaatctctctgaattagttttctcatgtgccaaatggtaataatagtatgtgcattatagaatgttttaaggactaagtaaaataaggtgcataaagtttacggtacatagcaaaaactccatatgtgttagctattattatttctatagttttatttataaaaggcataaagccataacatcttctgttgccttattctcttttgctagttttggagatgtggatagaggaggtgttgccaggggtaacaaaagatgggagccatacaaatagtctcaattgatttttgacaaaggtgcaaaaccaattcaatagtttttaacaaaatattactggagcaactggacatccacagttgggaaaaggaggaggagaaacttgatctaagtcatactcaaaatgaaacacagtatccctgaagaatacagatgcaaaaaatttcaacaaatttaacaaatactaatgaaccaaattcaacggaattctattaaaaagatcacacatcatgatcaaatgggatttatccctaggatacaaggatggttcaacatacaaaaaataattaatatgacattgagagaataagaataaaaatcacatgattgtcttaatgggtgcagaaaaagtatctgataaaattcaacacccttttttgataaaaactctcaacaaactggaaatagaaggaaaggacctcagcataataaaggtcatatgtgacaagcccacaactatatcacactcaatagtgaaaaactgaaagcttttcctcctaagatcaggaagaaggtaaagaggcccactttcaccacttctattcaacatactactggaaatactagccagagcaattaggcaagaaaacgaaataagcatccaaataggaaagcaaaaggtaaattatccctgtttccacaggacatgattttatatatagaaaatcccaaagactccattaagaaaatggttagaactaataaacaaatatagtaaaattgcaggaaacgaaatcaatatagaaaaatcagttgcatttctatacactaacactgaactatctgaaagagaaattatgaaaacaattcctattaataatagcacgaaggagaataaaatacttagtaataaacctaaataaagaggtaaaagacttgcataatgaaaactacaaaacattgacaaaagtaattaaagaagacacaaacaaatgaaaagacattccatgttcatggattgaagacttaatattgttaagatgttcatactacccaaagagatctacagattcaatgcaagccctatcaaaaccccagtgacattttattttcacagaaataggaagaacaattttgcaattcatagggaaatccataagatcacaaatagccaaatcaatattgagaaagaagaaagctggaagcatcacatttcctgatttaaaaactattacaaagtcgaagtaatcaaaacagtatggtactggcttaaagatagatatgtagaccaatggcacagaatggagatcccagaaataaatccattcacacacacacacacacacacacacacacgtacagttaattgatcttcaacaagagcaccaaaaatacgcaacagggaaagtacagtctctttaacaaacagtgctggaagaactggatatccacatgcaaaagagtacaattggacacttattttacaccatacacaaaaatcaactaaaaatgaattagacttaaatgtaggacctgaaatgtaaaactcctagatgaaaacagggggaaagcttcttgacattcgactaggcaatgatttcatgtatatgacaccaaagcacgtgtaacaaaacaaatataaacaagtgggtctacatcaaactaaaaagtttctgtacagcaaaggaaaaactcaacagactgaaaagtcaacctatggaataggataaaatatttataaatcatatatctgacaaagggttaatctctaaaatatataaggaactcctacaactcaataacaaagaaacttaacagcctaattttaaaaacaagttaaggacttgaacagacatttctccaaagaagacacacaaatggccaatagctatgtgaaaaaaatgctcaacatcactaatcattagggaaatgcaaatcaaaaccataatgagagatcaatatatacctgttagaatggcttttttttttttttaaagtgacaacaccaaatgctggctaggattctggaaaagtttggctgtttcttaaagaaatatgtaactaccaaatgaccccacaattacactcctgaacatttatcccagagaaatgaagacttaagttcacacaaaaacttgtacataaatgtatataactttatttataatagcaaaaaactgggagaatcccgatgctctcaacaggtgaatggtaaaactgtggcaagccctacaatggaatactcaatcaactatggatacacacgattattcaaatgaatttcaagggaattatgctgagtgaaaaaagccaatccagaaagattacatattgtatgattccatttatataacattctcaaaatgtcaaaattatagaaatggagtacacattagtagttggtggaaggcaggagggaggtgggcaatatgagaaacggaattgttctgcgtcttcactatatccatgtcaatatcctggatgtgatattatactacagttttgtaaaacgttactgggtaaaggatatatgggacctctccgaattatttcttacaactgcatgtgaatcttcagttatctcaaaatttcaaaaatttaatttttaaaaaaggaaaagaaaaaagatgtggatagacagaaggagcagactgaaaatagtctctgccatttgcaatacagttcagataggtgtcccagattatagcaggatttctagcttggcaggcgaatccactgtactgcagagatccctctggtgcaggaaagcaaggcagagttttcctgcagagccagcacttgctcctctcaccgggatattagttattgctcttacaaatttggaagctgagaggtgtgtcacaattaatgaaggttaggaggctctgggttagagtcagaactactaaagttcctgaaagtcctccaagcagctctgttgctgagatctaggctgctggtgcagaagcctcctcggaagtaatttaagcagagtggatctcaggggtaataggagtattcttttgcttggcctctgaaggagacgagggcaggccatatgacagctctctgtatggagacagcacggaaaagtaaaagagagggctgcgagttgtagaggagaaaaaactgagaaatcataagcttgacaagggagaaagcagaaatttctctgcctccatgtgtctgggtaattgggcatcaatttacctatcacgatgccatgcagtactacaggcaacttggaagaaaagtgttgggtaaagaacaactgagtgttgacatctcatttttaaaggcaaactgttcacacacaaatgattgcacagaatattaaagaccagccttcttttccatctggatgatggatctataaggagaatgcattcataccactggcagagtattttcaaatagatacaatcatctttcttgctgctctcttctcttctgtgatatcattaaacatttgattaacactgactttcaggccttcccaaacactggctccctgtttaccaaaaccactgaaaaatgcccaggctgaccactggcaatcaatagagttccttggggttaggtgaacatccaatgtgtctgaattgagacattcaaaggtgaattgacaatcctacttatgtgaatgcctgctgcagcttttgggaactggctgtctcacaggagcagtgcagggacatcaccacctctgtgctcattttccatcttccctaatgctccagaggcatggaggagaatcttgggtttccaagtacattttgtgttcagcccatttccacagggcatagcaccttcctgctgtttccaccttctcttctggctgccagctctattatctccatcagaaatttgatcctgttagaagtgctgtggggtatttttgtctattttttaaatagagccttccagtttcctttgggccattatgttctcctaaagcagtgctttgtcttcagtcattaatatttaatgtgactagaagctttcacaaaaacctattgagatgcacatgctttaggtggcaaagctgttatttaatgatgttggctgggtatactaattcaacctacccatgagggaaggtgacctcctggtccctctggttctgtgtctatattaataaaatggaaacctcttgccatttatgaaaatatctgttcaccatagaagagaggaggactataagatttttttctgacataataaaagtaactgatttctaaaaaattggaaaagaatattaaaaaatacaagtatgaaaagttgtacatacaataaatgtttattatggcattgctataagaagaaaataaattatgaataacccaactgtccaataacagaggattggttaaatacattagatgacatatttatataatggaaatctttgtagccagtaggaatgatgatgtaatctatctttactgacattgaaagatgccaagatacattaataggtgaaaaaaatcaggctacagaatagtatgtacaatatgattcaattgtttttattaaaaaaatagatacactggcaaaaaagccagaaaatgtatgcgatgaaatgctgatagaggttctctctgggtgttgtgattgtgaatgatttttcacatctttcttcacatttttcttctaaatttttaagcagtaggcacagtaaaattattttgctaaaaaatactacgggatggccaggtgcagtgtctcatgcctgtaatcccaacactttgggaggccgaggtgggcagatcacctgaggtcaggagtttgagaccagcctggccaacatagtgaaacaccgtctctactaaaaatacaaaaattagccaggcatggtgacgggcgcctgtaatcccagctactcaggaggctgaggcaggagagtcgcttggggagggggaggttgcagggagccaagattgtgccaccacactccagcctgggtgacagagtgagactccatctcaaaaaaaaaaaatgctatgggattgtggctatacaacttataaattacttttacttgaaattgtaatccaaatgaccttcatatttccattcaaacatctgtttttaatttagagaagaggatggcaaacttttatgtaacgggctatactaagtaagtattttaggctttacagcccatgtagtcacttgtaactactctgccttcccctttgcagtgctaaagcagccacagacaatatgacaattggtgtagctatgttctaataaaattttatttacaaaaacaggtagtgggctgaattttgcctataggtggtatttactgacccatgctctagggggctaaataaaggaggccgaagtctcagaattaagctagttttctctgttctcttgggtcaatgtgggtaatattagttgctgctctccagagtcaagaccaaaatggcttggagacatcactggagcgtctcatttttgctacttgagatgataattttcactctctatattggggccatgctttacatagggccaccttatccaccaaagtgaatcctagctctgccaaagataaagctgttgtgagagaagcccccaagtgactcagaagggttgaagaatttacaaccaaactactgagtgaccttagttagaaccagaaatttcaaaagaatcagtgcttcctgtagcccatccgtactaacatactccataaaccagttttctgaagaagcgaattattatagtgtatctacagaaaagcttttaaggagtcttaaaatgtccaacaacagcttaatttaggagtctgaaaaagacatacgtagctgaggcaaaatataatggggaaaaagaaggatgacttagccaaagatggtatggcactcctagtcacaaagagcaccacgatacccagaatagcagtggaacaaggttaactatgtgaatttagttcattctcttgtctttgccttaagttacaatcaatggtgcagtttcttaaagcagtttacttgacatatataatctataaagagtattttccaccttttctcttcaaagaagagttacttattgcatgcgcgtgcgcacgcacacacacacacacacacacacaacttacttctgaaatgcttccaaaatacatagcttccagatcaccccaatcctgccatctagaatattattaaatcacatttaatgttctggccactcaaagatagtcatctaagaagagaatgtattaggtccaggatccacggaaccagagccaactacttgggatttggggctacagcagagccagatgtcccaaatttctaacctgggaatttctgacatacagcacccaaaatttactgatagaatctcaggacttgcaggcagcccaggacacctgaggaacagtccacaacaagccattcagaggagtagggagtgggtaaggcagtctaagggggacaaaagaaagggaagtgggacaagatcatcaagagaaccaagaaagttcaaaggataatgtttcaaaggttcacaaggggctggaggatggagtcaagatgctaggtgctatgtgatctaagggcaaaagagaggaccagagaaggagcacagacatgctgttagtactggggcttctatttgatagaggcagattaagtgatttgttcaaggcccccatcagttaccttgaaatgtaaattcactctttcagtttctactctgatgttatatcccaccatgccatccagctgttcacaaagctggtgtcttttcctgaagatttaaacaacttagaaatattgtgtagtgtgtaggtgtgaaatagttgcttgactcctctgcggaggtggcagaaattttaaggtatggaaacttactgtgctaaaacctgtaagtgccatattctgaattaatagggctggatctttccagctgttcctggctagtggattaggcagcgtttccattttagagaaacaacactgaaatcactatagctacttaaaaaatctcaaatgtataacttaaatgaactgatgtagaggaaagcacagtggacaagaaatatggagacttgggaaacttggcttctagtgtcagctccatcactagatattctgtgttattttgactaagtcacttcctctctctggatgctagtttcctcacctgtgatatgagagggttggacttgataatctctaagggatctttcacttgtaacatttgatgattctgtaattcctggtgtgttttctctcctgacatttattcacaagggtcattctgccctccacacaatttaagtttttggcaaatcacagatggtctaaaataaaatctcccccttgaagaggggaaaagaacaggatgtttctgctgaaatagctcatgtcaggtatgacctttctaattcagagcagctctctagtggttcattaactcaccccatgggcagcacagcaagcaagtactatcacaaaaggccccaactgtgcagccaaagagagctgctctattacctgctgaaaacaaagtggtttcctctttgtgtccacatcggtcaatttttagatcaggaacatatgcttctatcactgaaggaatcctggccaactaatagaaaccatgtgccaagtctaacacctgctttgaagactaagctggagtcccttctacagggaagtgatggaattacttcgaaatacagatggtccctgacttaagatggttcgactaaaatttgtttgactttacgatattgtgaaagtgatatgctcagtggaaaccatactttgaattttgaattttaatcttttcccgggctagtgatattgggtacattagtctcctgtgacggtgggcagtggcagtgagctgcagctcccagtgagccacacgatcacgagggtaaacaaccaatactgtatagggtactgtgttgccagatgattttgcttaactgtggactaatataagagttctgagcatgtttaaggtaggctaggctaagctatgatattcggtgggttacatgtattaaatctattttgacttacggtattttcaatttacgatgtgtttatcgggcagtaaccccatctttaagttgaggaacatctgtaattgataagagtggttctcttttctagacaattaaaaatggttagaaggtttaatagtaattataatagcccatttttgtatagtgctttatattttacaacacatgctgataaatgtattttctcatttacattttcttaacaacccaccgaggtgaggagaataggtattactatcgccatctacctgataaggaaaatagggctcagagaagttaatgtttgtcccaggtcatagtaggtggcagcattgagaatggaactcacaccttgactttgacttgtccagctaactcaccaatatatttctccaattgtcctgttatacttgtgagaagttgtcaggaatataggttaaagaacagatcttagtacagggtctagatgctacaaagtaattttatgcttatttgaagacttctgacataggtttaatttgtcggaatgggatcggtggctaggagggctctgagaaaatacatataacacaatgaattcaattgatcattatatatctagagtcaaggcaaatatttactgaaaatctacacaagtgaccctatgcaagtgttatgagaacatatttaaaatataaaacatggttcctgacctcacaaagattcataagtggctgggcgtggtggctcacgcgtgtaatcccagctttgggaggccgaggtgggtggatcgcctgaggccaggagtttgaaaccagcctggccaacatggcataaccctgtctctattaaaaatataaaaaacagctgggcaaggtgacgcacacctgtaatcccagctactcgggaggctgaggcacaagaatcacttgaacctgggaggcggaggttgctgtgagccaagatattctgccactgcactctagcctgggcacctgagtgagactctgtctcaaaaaaaaaaaaaaattcacatgccctaaatagtgtataatgaagggttaaatatggtagtcacaacaataagtgctatggtggcatgggaaagagagaagtcagtgagggaaacattcatggaagaaatggaattaagcatttaaaggatggatagaatttaactggcggaggggaggaagaggatgattctagactaaagagtgagtaaagggtatgggaagagaacagcatgagctaaaccaaaggggcaggcatacatgaggttgcatatctgtgaggatactgatttgagtagagagcagtgggagaatgtcaagtagagccatgattcactctaagtgctcaaagggctgtctgcctttcataacattctgttcacttatgaataaaatgccattgaaggaagacataacaatggttaagagcttggcctttggagtcagacagacctgggtttgggtctcaggattaccacttacttgctgtattatcttgggttaattaattaacctcttggggcttagtttcctcttctgtaaaatgggcctgcaatgaagagcctatgataaaatcccaccaagtactgagcaaagtgctggcacatgaaagcactcattaaataggaaatgtaataaaggtgagccaatgaatgaaacttcatttttatacatttgttaagttttttcatatggaaaaactaaaaaaaaatttgatccaaccacttgctttaattttttattcaaattctgattcagaaaaccatgatggccatagctgtgggatggaataggagatgatgttgaacaagtaagttatggtttgatgctgcaggaccgtcatggttagtctgaggagactgccctgtggggaatatatatatgccttctgactaaggagaaggaaccacgggaatcagctcaagggcagttagcaaactgctggcaaaagtggcccaaggctgaaaactgctcatccttatctccatccacttgaccctctgagctcctttcattttctccctctaagaagcatttcttaaaggtatggtatgctggacacacttccctgccctcatatactttctgatggatgggaaattagcattttgttctgggtataatcgctttctaataagcaaagggtcagatacacggaggagtagtctaagaaacttcagggaaggaaaaccctggcttgagagaagtagaaggaaatatcagatgccaataacaataaacaacataatcccaggaaagagcaactgttacctgagcctggaaggtcatgaatgtggcgcatgctttcaaaataggagcccagggacatcgctgtaattaccaaccaaagagcctccccttagtaccagaaaaacagatggatacactaattaaagggggagagacggagaacaatgcaatctttgaatgtgagggactgaagagagtcaacctagctctgtttccgataaagaaaactgccctgttaactctgggtagctctaaccagccacagaaacctatgccaaatcaagtgttttcaaatagcattcaaatataattttcctttgtccagggtggactgcagtcttgcttttgaaataaatgaagcctgggaagccactctctatggccacatgtaccatttttcttatgtttaattcccctttctttttcagaggaaggggaaactcagattctaaaaacgacagcttgctgagcttgctggctgtcactgtttaaagaatggcttattaaacagatgatgtacaagcacttaaaaaagtaagtgctgaccagaaagccagtgtaagaacatgtctggtttggtacagataatttcctttttttttttttttttttttttttttttgtgaaagggctgctagaatgacatctttacagtgaatctttcacaactgccttataaaaaagatggagaaatgtagatcagaccagataataacttagctggattcctaactggttgaagaattgtactcaaagagtggtgatgaatggattgacaacaatttgaagggaggtctctaatagttgctacagggctctctacttgaccatgtcatgctcaatattttaatgtatgatttctggataaaggcataacaaacttgcttgctataactgtagataagacaaagttggagagtattcttaacttacttggtgatataattgggcttccaaaaaaatggtaccaccctttattgagtgtatttaaggcactactgtatataaactgtcccattgaaatcttaaagccaaataaactagggtttagagaggtttcaaatagcttatccaaagctacacagctagtaagtagcattgccaggacttaaacccaagtctgtctgttgtcaaagcccacactctttccaatacactacactgctagccactgctgtacactgtcttgacaaactagaccagaatatgctttctcctgaaaacaagacagaactgagcagaggctggaggctctgggaaacaagaaagaatcaaaccacatggattcaagagagctgactgtagctttcctgaaggattagagtagtgctagggtgacggtgaaaaccagcacttatactaataaactgctgagaatatttggagctagaagacagtgaatattgctacttcctggcattgttattatgtccagctttatttttatgagggaaagtggctggaatgatgggcccaaaactacgaaagcggaacataatataagaaaaaaaggtgggtgaccatagaagaatagaatgggggaaatatgacttcactatagttcatactagaaagagctaggagatttagtctgcaactttaacatgagccaacaacatgaaatgcctttcagaaaagtagatatacctcaggctgtattattagaagcactaagtggattccagagcctgagaagtaatagacacattgtcttctgctctggccaccattctgttgtgatgggcaaataacaacatttaacatcactagaggcttgaagtaactggggtgaagtgtttggaaactatttcctatgagggattttttttttttttttgagaaagagtctcactctgtcacccaggcaggggtacagtgatgcaatcttggctcattgcaatctctgcatcctgggttcaagtaattctcatgcctcagcctcccaagtaactgggattacaggcatctgccaccacacctggctaattttttttttttggtatttttagtagagatgggatttcaccatgttggccaggctggtcttgaactcctgacctcaagtgatctgcctgcctcggcctcccaaagtgctgggattacaggtgtgagccaccatgcccgacccctgtgagggaaattttgaagtaaatggaatatttagcttagagaggagaaaacttgtggaaactgtatttgaaggaccatcatgtggatgaaaagattagacttggtctgatgtgttttatattacaaagctaggacccagaaggcagcttatggttcaatataagaaagaaattcctaacaataagagtggtccaacatcgagtgataaggataataggttatatttaatgagtgtttcctaaatgcctagcactatggtccattgttgacatatcatttcatggaatccccataagaactctggaagggccatggacaggggaatggctacactgtaaagcagggatcttaatgtcacatggaatattcaaatacaggctagattaatagctgtcaggaatgtgtcatatgcaattgtgtattgggatgctggtggtggtaggagagttgaattagatggctctatgagttccctgtctgatataagactcagtaaatattctactttatctgttttcaactttataacattaaatattacgagctgatggtccaaagatagcattttgaactcttcgtaagattgctgctatgtgtctctgtttatacactcacacacacagagagagacacatttatttatttttaaatcatatatatgccagggtttgaaaaaagataaggatatcatttagatatgtggaagttttgaacaatttgaaatcctaacaatttttaatttattaattaaaccaatgcaacaacatgagaaaatagcatatgctgcatttatgataggcaggaattgaaatatacatcattttgttaaaaatatacaatgagaaaaatgtagaaaatgtaaatttcaaaaagctttcatttgaatgactggattacaggatgattctctggctctctgtggagtataaacataagaatttacagagctgtaacttcaactttctgtccatcactgtgctagaataggggttcccaacccctaggctgcagactggtaccggtccgtggcctgttaggaactgggccacacagcaggaggtgagcagcaggtgagtgagcattacagcctgagctccgtctcctgtcagagcagcaacaacattagattctcatagcagtgcgaaccctattgtgaattgtgcatgtgaaggatctagggtgtgtgttccttatgagaatctaaataatgcctgatgatctgaggtggaacagtttcatcccgagaccataccccccgactcagtctgtggaaaaattgtcttccacgaaaccggtccctggtgccaaaaaggttgcggacggctgtgctagaagattgaagagtattaccacatttaatctttgcaatgaccttataagtttggtatgaagatattatttccattttacagttgagaaaacagagtcttaagatagaaaagttaaacagcagtgccaagattcaaacacaggtatttctgcttcatactgtctactgtgctaaatcagtaccctcctcttttctttcctctgttaacggaaaacattttgaaaatatgctaaagtatagcacaaatgataatggttattattaataaacaactacaatgtccaatatccggattcatatgatgcttgtcttgaaaaaaaaatttactttgtaacagaaagcttggtctctttagcacagatagggacacatttggaggatcctggtttgttctataggcttgactttaggatcagaacaatgtgtttgaagagctattggagaataaaaaggcacagtaaaaagtgctcctcttctttccacaatctagattctaaagtgctgagagctgagaaaccaaacagtacatgtgataccacctactgcttattcactacatgcagaaccctgcaatggctatttatgaagacccagagaaagaagaccaacttctttccatgggagagctctcaatggaagagtgcccttaatgaaggttgtaaagcaatgcagtgaatttcctgaccagtctaagaactactgctgtatagatagtcgtctttttgatgaagcttcatgttcaccctcccttccctactagtataaaccattaaagtttagaaaaagtcctgcattcaactgattcttaagaatttaaataaggagagacaaaagatggcactgaagtactaaatactgccagaaaatatttggttggctagctccaactttaggcccttggtcggaatctatcatttgttctctgcagcctgtgatgaactataacctctgaatcaaagagagcatacgttctcacttccaagaagccatctatgctgtaaagaaaaattgctactgtgacaattcaagcaactggtgagaaaggtgagtgcatttcccagcatacacatttcttttaagcttcccgttaatgagcagcaatggacttcccagaagacactgtactcaccatttttcccatccagacaggacactccaggaacaattacaaaatcatgaacttcagtcacgtctgctgtctgacatagcttcatttccctagtggactaatgtgtacctgcttcactgccaacacaagagtcctcataaactcatagcttcatctttccttattttgggaccttgcttttggccttctcttatactttagttaagatgccctccttgttttagctattgaggatagtaagataacagctgcaaattagttcttggtgtctatcagaagtcagatttcttctgccttaattagtactgctttttaaatatcactgctatgatttccaacctgatatgtacctagggtccccattttcctccaacaagaatttcccactgccaaaactccctaccacaaaggaaagcagaacaaacaatcaagctagtctctaaccacaaatcaatcccatttccaactagctgatgaaaaatgtgagagtgacactagggtctaatcaagggaggatgggaagatgattacatttttgtctgttatcctaagccccaaaccaagctgggtggctgtgtctgtgtgtctgtctggcacagccagaaccagggctcccatgaggaccttctctctccatcataacaggacagctatgtgcaagtcagagatgagtaaacgtttggaggccagttaagaggctattagagtataacatgggttgctgacagtgaaaatataaaaggagaattatctgtgcttatctcctactcttaaatattaactgggatatgaaggagactggtgtcatggagttttcctaagttgtttgatggtgcaagctgcttttaggtttgggtggaagtgtgatttgaggcatttcccttggccagggaggcaggggagtcaagctatgaaaaatatttgtgaatcatggtttaaacaagtactctaaatgaagcccttaaacgtcacatgagatcttacattgtactctcctaaaagacagaacacaagtctactaagtttttgttttttttttcaactcacttaagacagcaattagcacttagcagaaagtctgaattcccccaaacctatttatatgagaaatggccttttaaatgaaaagtctgaataataaaaaaaatggaatcagttactcagcataagaccctttcaacaccaagggtttccacttattttcagaatttaattctcttgttcaactttgtaataatccatacagataaaagaaccccaagtacctcctggtttcagcagaatattgatcactacctctctgaatttgctttggagtttcaccccttggttgactcccagtactatatacagatgacctgttttaagacacaaagcagctctgagctgtgggcttcatgcccctgaagcagggttttcaaagagcttctctgctgagcaagctctttccacagtgcaattaggctcagccagaggacaaacagttcctcatcctatgtgtcttccattaataaagatttgcagcaatgtgtaccagacttggagcattactcagatctaccaagtccccagtttggggaagtggctctgattgattttggagtctctggtgtctttggacagatgtattcattcaacatgtggaggcctgcgggcaattcagattttagctgaggctgtagccaccattaaaacaggactgcagataatagcaaagattacaagcaaatgtagagttacatagttagaggaaaatactcattaggctcttgttttccccaaagttgtgaaaattcagaataaaaacaacaaagggcacagaaggttggtgtggcaaagtcagagtacatattaagtacactgcaacacattcagtacatcctgattttcaaagagaactgaaccaggaatcaagaagccataactctgtcatgtcacttcattttgagttaataagagctaacatattaagcacctatttattatgtgctagatactgtgggaagtatattactccttacttacattgtctcatttatttcttcacaaccactgtaggagtcttattaccttccccactacacagaaagcaaagagaagtgaaacacttcctgaagtaatacaggttacacagagcttaggtcagtttgatgcttaagcctgtgttcttaacctctttctatcactgcctgtcttctacattaagctccctacttagtagtctactctttttactaaattatattgactcccctctttaatttcttcacttactagactattacaaagttgaacaagagaattaaattctgaaaataagttgaaacccttggtattgaaagagccttaagctaaataattgattccattgggggacatttggatgggatgatcctagaaccaccttaattctaaaaatacagtaatttcataaagagtgaggaaaaaagctattttttctaggtgattgtggatatagttccagtagacacattccaacttggatcttaaaccctaggctgagtgactttttctcctgcgaatgttagttgcttgatgccctggagtactgaacttcctattcacctctctatgatggtggaatgacctctatgaagcaggctggggaattttctaagaaaccaggtcactgctgctgtcttagcaaagcacaaacagtgtagacctattctcattctctagttcccatggttctaggaggtaggctgagcctggtcctcagcatttaattcactttgcatagctttcttcttcagggcaggagctgggctaagatcatcttagagtctggcacaacaaaaaggccacctatggagtctactttcttatttatttgcatattttcatacagttggggcagcaaatattagatgcccatcataattaagaaaaagcccaaagtcccttgaagacatttaaagtgaaatgcctacaggaagaagagaggtttcctctagattttttattttaaaaaatgaaaataatgttaaacttcttggcactgcggctgaatattaagtagaaacatcttagggaaacttgcctgagagctatatgaattctaaactatgaaaacaagacactcagtagaaaactgtaaaggagaaaagcggtcagtttgctttatcaaagaaacaaagcattttcctccagggagaaaggaagcatgatgggaaatctgcaaacaatggacttctggaaggtttcatgtgtttgcttaaaaaccaaaataacaacaacccaaactccacagtactgacaggggacaagtgttctacctaatagcacatgggccatgggatatttccaaaaagcaatgatgttcagactcagtccccttgcgagcatgatttgaataatttttgccagacaccaccttcccccaagtctctaccatgatctagggacaatgctaaaatttctccctgttgtcactcatctaaggctcaaaaggaagagcatttgtagtagtgatggtggggcctttgacggtaagagtgagagggcacctctccatttattttgcaatttgtctctctgcttgcatttttgtctatgtcatagcacatctgtttttctgtctatttttctttctgtttctctgtccgtctctcagtccatccatcaattcctctctgcctgtgtctccttgtctgttttgacactctctctgtcttcctgcttcttgtcactgtatggttctctctctcaggttctgtctctttgttgctctttgtctgttgctcagtcagtgtctttctttcttctctctctctgttgctcccttcctccctctgcctgtctgcatctcactctgtctgtctatctgtctctgaccaacggcttctgacaatctatttacttttctctcattgtttaaatatccctgtttaagtgtccctgtctagttttcagtctgtctgtcttttggttggtctgcctggtgctctatgtctgccttcctgtctctgtcagtatctctgcctctctgtgcctctttgttcatttctttgtctcagtatctctgttaatactttgtctcttttgtctttctgtcagtctctgtatgtgtctctttttgtttctctgtctctgtgttacccatctgtctgtctgtactctggttatctgtccaatctgtctgcctgtttctccaccagcctgtctgtccacttgtttctctgggtgtctgcatgtatttatctcagtctttacttctatctctttgtctagctgactatctttctctataatttttttctctcaccctcttcctctctctcgggctgtcagccttgctgtgatcctctcagtttctctgtttcttgtcttttggcctataacacatggtatctgtccaactctttcagtctcccatctcggtcagtctctttgtcttggtttgtctgttgctctctcttcccaagtctgtctttctgtctcacagcctacgtttttctcttgtcaatctgtcttcccattcttctctgttggttttcatttctctttccctctgtatctgtctttctctgcctgtctgctgctctgtgcttcttgccacattagtccctctctctgtatctacctgttctgtctctttgtctccctgtcttttgactctattcgtacctctctgtttctatccatatctctctcattctataataagtgtccctctctctgcctgcctacctgtctgggtatctgtctgtctgtgtttattctttcctttagtagtttggctggctggctcactgtctctcaggctgttttcctctctctctttctgtcacaatgtcaccattttaaagtgaacaattcagtggaattaagtacattcacactgtgcatgcaagcactacttttatctagtccctgtccccaaatattctcatcactccaaaagaaaagcctgtactcattaaacagttgtcctcccttcctcccttcccctagccaccggcaaccaccaatctactttctgtctccatggatttacctattatagacatttcagagaaaaggaatcatacaacatgtgacattatgtgtccagcttctttctctcagaataatgttttctaggtttatctcccttgtagcatgtataattatttcattactttttatggttgaataatattctaccgtatggatatatcactatttgtttattcattcatccattgatggacattaggtttgtttccacctttttggctatcatgaatatagctgctatgaacatatgcagctatatatgcatgcatacatgcttgtctgagtacctgttttctatccttttggatatacccagcagtgaaattgctggttcatatggtaattctatgttttactttttgaggaaccaccaaagtgttttctaagtggctgaaccattttatactcctaccagaaatttagaagggtgccaatttctccacattcttgaaaacagttgatattttctgtcttttagattctagccatcttaatggatacaaagtggtatttaattatggttttgatttgcatttccctaatgactagtaatgttgaacatcttttcatgtgcttattggccatttgcatatatcttctttggagaaatgtctatttgagtccttagcctatgttttgattgagttgtttgtctttttgttgttgagttgtaagagtcctttatatgtcctggatactatacccttaccagatatatggtttgcaaatattttctcccagtatgttttctctcattttctctatgtctttctgatagattgaatctattacactgcctctttctgactacttctctgttggtgtctttgtatcaatatgtcccggacatgactctataaggctctacctgttccttctttcttcatctccctccttaacctttcttttttagtctgtctctttccttccttccctccctccccatctgtttcctctatttccctgcatgtgactccctctttttctcactatttctccctgccctcattcatctctcagtttgtctctctgtccatttagttggctctctatctctctactttctgtcttgctctctgtgtctttctgattctccctttattggttagtctatcagttgctttgtttatcaccctatctctctcccccagactctcttgggtctctctctctctccatctgcatctctctctgtattgccttttctcctatgcctcatggccctccctttctgtctctctaagtgtcttgtctcagtgtgtctctcaatcactgtctcagtgtctctctccggttctacctgattctcctgacactttttctgtgtctacctatctctctgcaacagtttctttttgcctctttctgtttctctctctccttgcctatttctctcgtcttcctgtttttctgcctgtctgtctcttagtctatcaggctttctttccatttgtctatctcctcatctctttctttctctttcctttgcctctcccatatagctccatctggccaactctctctgtctgagtgactttcactgactctctttctctcgctatctcactgtcttttctatcttgctgtctcttgtggtctctgcttctctctatgatgatctgtctctggctctgtatgtatctccctcacttctttctctgtcccttgctccttctgtgtgttctctctgctttgtctctgtctctgtcttcctgtatcacattctaactcttcatctctctgcaatacccgcaacaccccacttctctgtctatctctcagggtttgtctgtccatgtgagtgttatttgcttcttttctctttctgccaattttactctctctcttttcttcttgactttctttctcactcagtttctctctccttctgtctctctttagttctttagctttctctgcttctgggtctttctctctctaccctgttttctctctctctttgtgacctccccattctatctcttctgtttcagtgtgtccccatatctctctccttgttcctcactgctgtctctgttcctccttttctccatctttttctgtttgccagtctgccttcctttccacctgtctgcttctctttgtctgtccatctctctttgtatgcttccatctctctatattaaccagttgatctctatacctttatctatccatgtttgcctctgcctttctgtttttccatctgactggctctgtctctccttcttggtctatccttccctgtctgtctatccctgcctttatccacctctgtccattcctatctttatattcgcctgtctatctccctctggccatttgtctgtctgtctctgctcttctttgaaagcatgtggtatttatctttccatgcctgacttttatttccaggctgatccattttgctgccaaagacatgattccattcttttttatggctgaatagtattccattgtgtatatatgccacattttctttatccattcatctattgatacacggttagtttggttctatatcttagctattgtgaatagtgttgcaatgaacatggtggtgcaggcaactctttgatatactgatttctttttccttggataaatacccagtagaaggactgctggatcatatggaaaggggtggggagcatggggagaggttggttaatgaatatgaaattatagctagataggaggaatgagttctggtgttcttcagcaatgtaggatgaatatggttaaatatacttattatgtattttcaaaaagctagaaaagaacatttttgaatattattaacacaaataataaatgtttgaggtgatgagtatgctaattactctgcttagatcattacacattgcatacatggctcaaaatatcaatctgcatcctataaatatgtacaattattatgtgtcaactaaaaataaaaggaaaaatatggaaaaagacaaaaaagaagctgaagtataaaatttctttccaacctgtgccagttgaacacatgaatctcagagaatggacttatagtctttggcttgcgaaaaatgcatggattgtactgacttacgaaaaataagtctaacatgtctacctagtacttgaaaaacacaagtatacaccaactttggtatctttcaaacactgtcacttagttgtccactagtgaaaaacacaacaaaaatctatgtgctcagcaaagacatagaatcaacccaggtacctatcaatggtggattggataaagaaaatgtggtacatatacactgtggaatactatgcagccataaaaaagaacaaaataatatattttgcagcaacatggatgcagctggaggccattatcctaagacaattaatgcagaaatagaaaaccaaatactgcattttctcacttataagtgagagctaaacattgggtacacatggacacaaagatgagaacaatcaacacgggggattacaaaagggggaggggagagaggaagggaagcaagggttgaaaaactacctgttgggtaccatgttcattacttgggtaacaggatcattagaggcccaaacctctgcatcatgcagaatactcatgtaacaaacctgtacctgtacccttgaatctaacattttaaaaaactacatgctcagagcatgtcttgtaaacctttcatttggcttatattttaagtaagcttccagaactcaagaaatttgagaaactaggagttaagggacagactgcatcacataaaatatagagtctgaacagattgtttttgaaaattacatcaccactgaaacatacagtgatccagaattctgcagactaaattacatcagcacaatcacttgattttagtctaacaatctagtttggtaatcctatgatgtaagccctaataataaggaaatcattgaggcattatggaacaatgtcattaaacctctctgtgtctcagtttcctcatctataaaatgaggctaatgacagtaaatgaccttataaggttgttatcagaagtaaaggggataatccatgtatagttcttagaacagtgcctggtgcagtaggagctcaaaagaaaatgttagctgttattttttctattgttgttgttgcaattcttatcactgttattatcatataaacatctaaatagcactggaatcaggagagctatgtgactttggtaaagtctgctctctgggaagtttccttaactaaaaaatgaagatgtacctctaaaatttttatggttctatggtcctaggattccatgtgtttctgagtactaagcacatggggtcacatgtttttttaatttttaattttcatgggtacatagtaggtatatttatttatagggtacatgagacatttggatatagggatgcaatgcataataatcacatcatgaaaaatggggtatccatcccctcaggcacttatcctctgtgttacaagcaaccaaaccacacccttttagtaatttttaaatgtacaattaaattattttgactatagtcaccctgttgtactatcaaatactaggtcttattcattctttctatttttttgtacccattaatcctcccctccaccccaccaccactacccttcccagcctctggtaaccatccgtctactcactatcttcatgagcatgagttcaattgttttgatttttacatcatggggtcacatttttttatcaggctccatgatgtaatttttatcctcaaaagttgtcagacctatgttacaaaggaacaaaaaagccacaaggaaaatctgtttttcaaacatttctaaagctaacctgacatctgcaaacctctgctttctcactgacttatttagctcttacgggatcccacaacaaaaagcataaattcaggaatgacatccattctttctccaatgatgcccatatcagacagttggcgtaggtaacatttccacagatgtggacttcacccttgagagctagagtgccatatttttaaaagaggatattgtactttgcttcaaattgctgcctgcggatgttgtacccttcctgggaaggctatttatggctattgtatgttttttgtgaagactgtctaggatgtcatagctttcctggaaatagtctttgcatgttatatcttgcctcagaatggacgttgcttctttcttggaaatgctgctcatggatgttatcgtccctgggatgctgtctgtggttgctgtaactggcctctgaatactacctgtggatagtgtacttgacttttgatattcactgtggctaatttatcttctgacccgaggggccctccactgaagctgcttctccagtgcagtttctgagggagaactaagaatatgtttctggtacttgtgggtttgtaacttgattcattaacattttctccagactgaatggatctcatgccctaaactgtgttcaataaatataatctcttgccatactctgcccgttttctggatggataagctgcaggtgggaagctattgggaaagaggaagaatactaattggtaaattgactttgggtcttggacaacagcttgtagtacaaaaactctaacttattagctaaactaggcaattggcaatagttgcctctgaaaaagatgaaaactggaagcacaaagcatattcattcaggcaataatgtaccctgtactgtggtaaatgaatcttcacctttgtaagcacagtgctacataattgttcagaatatttcctgtgactaaagcataaaattttcatacgtcccataagaattctcaaatcttaattactcactcttctattttcttcatcttcaatattttccttaggatgaggatgtcaaattccctgtgggaatgtggcaacatatatttatcactaaaacctatcttgtctctgctcccctaatcctgccagcattagcatacctgtgctcattcatacacatgctcgttcccttacaaattcatgtctcccactcccatagacatgcacaatgcattttgtccaagctgtactggtgaaagaataaggtcatgtagctaaggaatattgatcttgaggggcagattcatagaatttacacaatgtagctccaagaaagatcctgattagttcctgcaccttcacattctctgcaaaaaggcatgacaggcagcagaaaataaccttttgtggttaaaatctttgtgctttaagatgaccagggaggaaagaggtatgatggggaagaggtcatcaattcaaaaatggcccttcccagttcttatgtttcaattcttttaccactgcttttcagaatggggatttagctgtacttaagtgtcctgtcccttaggtggtcattcacttgtcttaatattttctttttaattatacttttaattagaaataattatagattcatctgcaggcataaaaaataatacagagagatactacgcattctttttttttttgtaagacagggtctcactcggttgcccaagctggattgcagtggcacaatcacagctcactgcagcctcgacctcccaggcttaagcagtcttcttagctcagcctctcctgtaggtgggaccacaggcacacaccaccacccctggctaatttttattttgtttactttctgtagacatgaggtcttgctatgttgcccaagctggtctcaaactcctggtttccttgtctataaaatgaggcttatgacaataaatgactttatacagttgttatgagaagtaaagcagtcctcttgtcttggcctcccaaagtgctgggattataggcaaggcatgagtcacctgctcagccaatactatacattctttacccattttctcccaatggtagcatcttgcaaaattacagttcaatattacaaccaagatattgacattggtgtggtcaagacacagaacatttccatcaccacaaggatctctcatgttgcccaacttttatagtcataactacttctctctcccacatactatcttcttaacccctgacaaccaccagtctgttctccatttctataattttgtcatttcaagaatgttatataaatggaatcatacagcatgtaacctttcaggcttggcttttcactcagcataattctctggaaattcatcgatgttgttgcatgtgttgacactttgatcttcattatacttaattagtatttcaaggtacaaatataccacaatttaactactcacccattgaaggacatctgggttgttcgtactttttggctattataaataaaaagctataaacattcatgtatgaagtcttcatttctttgggatcaatgtgcaagagttcttaggcattttaagaaacagccaaactttctccccatggctataccattttacattcccatcagaaatgtatgagtgatctagtttctctgaatcctggccagaatttggtgctgtcattattttttgttttagccattctgaaaggtgatatctcattgtgactttaattttcatttccttaatggttcatgatattgaccatcttttaaaacacttatttgccgcctgcatatactttacatgaaatgtctgttcatgtcttttttcaattttctaattgaattatttattttttttaccgttgaatttgagagttctttatatatcctagatactaattctttgttggatatgtggtttacaaatgttttctcccattctgtttatcctcctaacacggtctttcccagaataaaaatgtaattttgataaagtctaatttatcaatttttttcttttatggactgtgtttttggtgtcaagtttaagaattatttgtctaaccttaggtcctgaaaattttcttctatttttttctctaaaagttttataattttatattttaaatgtaagtccatgatccattttgagtatatttttacaggagtaaggtttagattgaggttcattaattttacccatggatgtccaatttctccagtatcactgaaaaggtcagatgccctccactgaattgtttttgcacatttgaaaaattaattttgggaggccgaggcggttggaccagctgaggtcaggagtttgagaccagcctggccaacatggtgaaaccccgactctactaaaaatacaaaaattagccaggtgtagtggcgtgtgcctgcaatcccagctacccaggaggctggggcaggagaattgctggaaccagcaatgagcccagatagcgacactgcactccagcctgggtgacagagcgagactatgtaccaaaaaaaaaaaaaaaaaaaaaaaaaaagtcagttgggtgcatttatgtgggtagttttctctgttctctattctgttccattgatctgtatctgtccacaagcaccacacagtcttgattactgtagctatatagcaaaatttaatattgtgtagactgattcttcccactttatttttattttttttttgagattgatttagctcttataggacttgtgcctttctacataaatgttaggataatcttgcctttatttcagaaataccttgctaaaattttgatagagattgcattgaatctaaagattgatgtcatgagtaccgacatatttactatattgtgatttctacatgaacataatgtgttactccattcatttaggttttatttgatttctttcattagtgttttgtgattttcagtatacagctcctgtacacatttcagtaaatttatatttaattatttcattttatttggattacttcaaatggtattgtcttttgaatttcagtgtccgtgtgttcatttctaatatagataaatacaattgatttttgtatgcttatcatgtatcctgcaaccttaatggactcacttattagttctaggagcttttttgtttctttattccttttgtagatttcttgggattttctatgcaggtgatgtcatctgcaaataaggacattttcacttttctgatctgtaagccttttatttcatcttccctcatttttctgatctgtaagccttttatttcttcttcccaccttatttcattggctaaaactaacaacattatgttgaataagagtgtatatccttgccttgtttctgatcttaggggaaaagcaattcagtttttcacaggtacatacaatgttagctgtaggtgctttgtgaattctctatcaaattgaggaagtggctggacacggtgaggaagtggctcccagcactttaggaggctgaggcaggtggatcacgaggtcaggagttcgagaccatcctggccaatatggtgaaaccttgtctctactaaaaatacaaaaattagccaggcgtggtggtgggtgcctgtagtcccagctactcgggagcctgaggtggaagaatagcttgaacctgggaggtggaggttgcagtgagctgagatcatgccactgcactccagcctgggtgacagagcaagactccatctcaaaaaaaaaaaaaaaaaaaaaaaaaaaaaaaaaaaagaggaagttagcctccactcctatttctgagaggttttttttttttttaaatcatggatgatgtttaagtttttcaaattctttttctgcattgtttgacaaaattatgtgatttttaatctgtagcctgtgaatatggtagattacattgattgattttcaaatactgaaccacccttgtagccctggaataaaccctactttgccatgctgtgtaattctttcaatatattcctgaatttggcttactaatagtttgttaaggatttttacgtctgtattcatgaagaatactggtctgcacttttcactttgggctgcttttatctcatttttagtatttgtgtaatattagtctcatagaatcaattggaacttgttctctcctcttctatttcctggaagagattttatagaatttgtggtaattcttctttataagtttggtagtattctccagtgaaaccatctcgccccagagatttgattttgggagattttaaatgatgaattcaactttcttaatagttatatggctattcaaattatccatttaaacttggatgaattgtggtagtttatatttctcgaggaagtggttcatttcatgtatgttgtcaaatttatgtaggtagaattgttcatagtagtcccttagtatctgtgttaagtcattcttgtattgctataaataaatagctcagactggtaatttataaaggaaagaagtttaattgactcatcgtactgcaaactttacagaaagcatggtgctggcatctgctttgcctctggggaggccttagtgagcttttactcatggacaaaggcaaaatgggggacaggcatgtcacatggtgaaagcaggtacaagcaaagggctggggcagggggaggtgccacacactttaaaatggtcagatctcctaagaactcaccatcatgaggacagcactaagtcattcatgagggttctgcccccatgacccaatcacctcccaccaggccccacctccaacactggggattacatttcaacacaagatttgagtggggacaaatatacaaactatatcattattgatagtttgtactgatagcctctgtttcatttctcatattggtactgtacgtctttttttctctgtcagtcttgctaaaggactgtcaattttattgatatttttcaaagattcagttacttgtttctttgttttctgttttcaatttcattgatttctcttcttatctttagtatttcttcctccgtcttgattttagtttattttgttcttatttctctaaacttttaaggtgggaacttagattaattcatttgagactttgcttcttttctaatgtatatatttgcaactataaatttcctcctcagcactactttagctgcttcccataaattttgatatgttgtattttcattttcattcagttcaatgtgtttttaaaatttttatacttggttgggctcactcctgtaatctcagcactttgggaggccaaggtgggaggatcacttgaggccaggactttgagaccagcctgggtaggtaacatagcaagaccctgtcactacaaaaaaaaatttaaaaattagctgagtatggtggtgcatgcccatagtcccagctactggggagggtgaagtgggaggattccctgagcccaggaggtcgaggctgcaatgagttgtgatcatgccactgtactccaccctgggtgagagagcaagatgctgtctcataaaaattgcttgagacttttgctttgacccatggtttatctagcagtgtgttgtttagttttcaagtctttggagattttcctattacttttctgttactgaattctcgttttattccattgtggttggagggcatgctctatatgattcaaatttttaataattttttgaggtttgtttaatgacccacgatgtagtctatcttggtatgcattgtgtgtttaaaaagaatgtgtattttgctcttgttggatcctattctttgattattttgctgagtcctgatacccttgtggattttccatctagttgttatatcaattattgagagagggatgttgaagtacttaactatagttatggatttgtctaatcctcctttcagttatatcggtttttgtttcacacattttgcagtactttggtccatatgcatttagaattgctatgtgttcttggtgaattgatacttttatcactatataatcttcctctttatccctagaacttttctttgcaatgtagtctactttatcttatattaaaatagtcactcttgctttcttttgattgttttcccatagttttgcttattgtgttctttcttccttcctgatgtttcgaggtttcaggcaggggaggggggtgttattgcctcattattgccaaatggatgtagaagtccaggttccctactcaccttccagtgatatctgagggaggtagtctccttgttactgatgggcaggggtgggagttccagctccccagtagtctccaatgacactttgcaggagtggttttttatttctgggtgataaatacagtcgtgaatctcctggaggtctcctctgataccactttagtgggtaggagcaccttcataactgttaactgtcagagacaaacagaagtccaggctccccagatggcctttcctgttacagtgggataggagtgggttggatcattgtggccagtggggatgaaagttccagcttcagcctgggcatggcagctcacacctgtaatcctagcactttgggaggccgaggcaggaggatcacttgagctcaggagtttgagaccaacctggacaacatagtgagacctcatctctataaaaataaaattttaaaaaaagttccagcttggtactttgccttctctgatatgatcttggtggagacccctggcagaagtgttgatgtgcctcattaaagcttcatgaaggtagaaatctatgctccctacttggttgggagtgggtaggagtaggaccacaatttgtgtgtgtgtctggtgtctggctagagtagagagcttagctattgtctacaagttttccttgttactaggcttcctagtcctttggctaaagagcgtacgcttttgttggggcttttattttgtctgtacccattggtgtttctgagttaccagtttttttcaactccaagtacgagatatatgaggcaaaaccaaaatctccgagtatgagatatgaggcaaaaacaaaatccaaaaaacttgaggaatgtcacgcctcaagttctgatgtccctagacaatctgccttctctgcagctttcagccttcttaggattttttaaatatataatatccagggtttttagttgtacttagtgggaggaataggaaaaagcacatctaatccatccttctggaagtggaagtttcccgatttgtcttaaattttaagatgctcatggttaaagggacatatataacctaatttcttcatatgatttcatcttctgctagtcttttacattttttcccattacacattgaacccccaaccacaaaagaacactgagatccgataaccacctccaagtcattttttctccattgagacagtaaaacttgtttcctaaaaaggtatagtacagtttttttttttttttgatggtgggaaaagaagagtgtgtgtagcaaagaatgaagaaaaggtactaggtaaggtccaatcaatcaatccatcaatcaatcatagctaacagacttgcagatccaggctaagagcacaattttttctctaacaactgattcatcatacaccttagttttctagcacattgccctaattcagtaccatctgccactattagattaatatacaattatgattttgagtaccaaagtcataatatgcagagcttaaagcttttgttgttggtaacatcctaaaagtacatctatagagtaatttcataattaacaaaaaagtacaatttaatgaaagatgtttagtggatttataaaaggttgaaatttcagtaactattaaattttaaactagtttgcttagtcatttggggtgatctcatgcaaattaatatttctcagaattattaattatcagacacaataggaagataatgattgcttgacagaaagaaaaatgaggagtaggaggaataagtaatgctagcaatgacaactgtcatttacccagccttattttatattaaaagcattgggctacatactttatgaatttgtatttattttagggtctcaggtacattaaattggaccagtcatgacacttggttcatgacacactctcagcagtggtccgctagttatttagccagttattttaagtaatgtaataagcacctgtaaacctacaacccaaaataaaagctaagatcttgataataatctacatctaaatataagagttattcatccccatcctacctccctccctcctcctagccaaggtaaccatctcctaaatcctgtgttcattatccacttgcttttctttttatatagttttattatacctatatgtaatctcaaaattatatgttttaattttatatttaacttcataaaaatataacatgctctatgtaatcttttaggccttcctttttcacctaattttatattgctaagattaatccatattttgtgtgtggttgtagttcatttgttctgaatgctgtataatatgccactgcatgactataccacattttattaatctattaataatgctgatgagaatttaggttgtttctagatttttgtattgtgaattgtgctgctttaaatatgcttgcatgtgtctcctgttatccatgaatgaatcaaagattctcttgagtatttacctaggagtacaattttggggtcacagggtatatgtatgttcaactttcagagaaaatgccaaaattgcttgcagcaatttgtatatattcctacaaataacacataagaaatcatgtgcttctacatttctgggctttttattattctcaagaatttcatatgtctaacactttcctttcttagcatgggttcctcatctgaaccacagaacatagacaattatttgagtgtctatctatattctcaattctctaaaagatagtatatatctagtattattctaattacataagaaagaaatcaattatttatatgcaatagatgtcttaaggcattagtactttgttctttccaggaaccccaatttagaaggactgcttggtattgtcactttttattttttgtcaaccaactgggtataaaagatatcttatgtgatttgatttgcattttcctgattcataatgatgttttatctctgaacaagctaactggccaaatgtgtgtgtacaattttctgaaatgtctgttcatgtcctttgtccattttttctatgggactgcttatgttttcttaataatttttccaacttctttatgtattcttgatattatttctttgccagttgtattttaagaatattttctctcagtttgtaacttgtcttttctcattctctaacatgtattttgatgaaaaaagttttaaattttaatacagttaaatgtaccaatcttttattttatagtcgattctttttgtgccttaacacatctttcactatttcaaggttaggaagatattctatgatattttctattaaaagttttggaattctgttttgaaatgtatactcttgtaattgatcttgtatatatggtgggaggcaggttttattttcatttttcttcatatggataaccatttttccagctccatttgttagtctccaaatttcccactgatctgacatgctacctctgtcacacatcagacctccatatgcacatgggtctatttctgggttattatattctgaagaattttacattcattatttcatgtagtcttcacaataagtaatttgacattatttcatgtaatctgcaaaatcaccttatgaggtaggtgctattttctccattttacagatttagaaaatgaaagcttagagacactaattactggtaagatcacaaactaatctatggatgtcagctctaagccgaagtttccagagcccaagctttcaagccataatcaatactggctcttactctactacttcataagaatgttgcaaaagtcagtaaatatcacaggcagtaaactatatgtttagctctgtattagttactgggtggggtgaggtagggtcaaggatactgttgtgaaggaaagacaaaattgtagcctttgttcattttgtgtacccttaacttgctttattattattgctttttgaggtaattaagtaccagaacttatatatctatttgtttattatctgccccactcactagaatgctacacgagagcaggaacatatattgttttatttactgctgtatacctatcaactaaaacagtacctggcacagagtaggcatatgataagtatttgtggaatgaatgaatgtatgaatgaataaacatgataatgcttctgtcactggaatatggacaatctcacggaaaatattttgagttcaaaaaaatcctatgaaagtaggaaaaatttactcattcactcaatacatgtactgggtacctactatgcatgtagcactgtgatgagtactgatagaagagatacaaagatgagtaagacatgaaccttgacttcatgaacttacaagctagtagaatctacgtgtgcatataaattcctataatacacaagaaatagtaagtgctataagagaaaaatgctaatttgaacacaggagaatttaattcagactagaagatctgggtagccttaatggtagaagtcgccatgttggagcttggtcttgacaatgtttttccttcaaataagatgaaaactgtggaagtgcactgcatacttatttagccaaaagttactacttacagatatctttgcataaagtaacccacacagtggtaaaacattttcatttgggggagcatattggattttgcctggttaagaggaggaggatatttcaggtagagggaatggattgaaagcatagggcatgttttagcaaggagttgaatgttgctgtaactgggctcaagggagacagggtggctggcatttgaagtcaagggttcaggctatttgacacttttaagagactaagtgacagtggaggaggcaggcaggtcataacaggcagttattttcttttctcttctttctcccttgttatgttacttcctttctcttttctttttcccatagcagaatgcaatgaaaaagaagacaggatagggagtctgaagacacaaaatcaaggcatagttctgatactgaactgctgtatgtttggaaacttaattcaattaaagctgggggcagggagcagttttctaaaactacacaaatgcccttctccctgtaaatgttttttgttagctgctccaaaaggaatacctccttctagctgctatcaccctctcacaaggatcactgctatagtgtcagataaatacacccttaggcatgttggttgagaatcactgaacaaaatgatctctaagtgtcccctctttccaaccaccccagcctgctgtccaccaccttgccacattatctgattcttttcttattcccaactaagctttcagtctaacagtagacttgtatatggggattgcttggtctttctggaggtgcacagggctacaaattcttgtcctggaggaaaactaaccatgagtggccacagaaaactgaaagacttgagcacctgctccacaggcagggaaggggataaaattactgggctgccactaacttgcaaaaataactcgggggctatcctggatgcaaaagcagcctgatcctttcaaagaacaattgtgagaaatgatgtgtgttgtggggagggcagagaacagagtgacagaattctaaattatagagctatccttcaaggcctaattctttagaactttctcagatatagtttggatgggagtgacagggtagggtagagaggggaagaagatgatcggtctaagattcatagtcttttttttaagctgacttactcttaagaaagttttaaattgcacacaaaggaaaatgcaccctccgcatgacgctctatgaagcctaattattggagcaaatgtttactgaattaattttagaaatacaataccaatgctgcctgtttcataatctaggggaagtattttcttctcaagccatgttcagcctgcaacaggaagccaattatcaccccagaacatttctcagtgaaaaatatgtcattccttcttaggacaattaaggcttaagcaggcttaagcccccatctcacagtgttttcttatttttaccatctaaatacctatcaatccaaaccaagatcaattccatttacataacctaaagatgtcactaacatttggacaagggaaattttggaaaaggacaagatatcttttttgcttacttgaatgcccacattggcttttcctgaaatcagaggataataatggggctgctgagggaaaaatgcaggaaataggcagtggtactgattaaatgagagtaaattcagttttattactttcatgtaaactcagtaattctaactaagaactaacaaatgtagtccctttagaattcctaggaaagtgtttttcatcagtggaaggaaataatttctagttaccagatgtacgcactctgaagactggagctaggtcttactcaagtctcggtttctgctagaaattagcatattcatctacccttccatccaacatcacctgacacacagtaggcatccaatacatgtttgccgagtaaacatattggcatattatgtttgcaattgtctgctcttgagaatgcttccaaatggcttgcataaataggctaaatattgtcctgagagcatttttaaaaatgcgattagcaaactttttatttcttagagatgacaaatttttacagtcctaaataatatggatagaaatttaagatgttttccatgtgccaaaagaagaagacgttccatttccctttatagacatgagacagaactcttccagagctcattctgtgtaatcaaacactttcaagtggcaaccaaacattccaacgtgcctaagctatctgaatgtcatagcaaaagacagctggtgatacgatgttagaatgaccagaatttataccatattcacattccctttagcacataccagattccacagctctaagacaggtgtgttctgctaccctatttttccctcaaagagcacctggagcctgtctagaaaacagaccaagagctttactgccaaccactgtaggtgggatgactagattttctaattatagaattaggaaaacgtaatttgacatacgcacttgtacttttgggggcaatgggatagaacatgtgacactggggctgctctgaaaactccagaaagtgtggatttccatgcttaaaggaatgactagagaatctacaaaagggaagtaactttataaaacagacaatgtgaaagaacacagcacaaacagtgttaaaatacatgagaaaacatttataacacatttaacagagaaagcattaatttacatgacataaaaagaacccttacaagtccataatttaaaaaaaaagaaaaatgggcaaaggatatcacaaatgattgataaaagaaacacaaaggactagtaaacatttgaaaaatatgctcaaattcagtattcatcacaaaaatgcaaataaagcagtaaggagctatcattcctgacctgtcaaattggcaaaaatttataggattaatgatatcatgcactggcaagaagacaggaaatgactcaaataccagggttgagattctgacttggtgaagcctttgcagaagccattgtggtagtattcgtcatcaaaatgtacaaggcccttaacccttcaacccagcaaacttacttcttggagtctattctagagtaatacttgttcacgtgtacaaagcagcacgatcatggctgttcattgcagcactgtttgtggtggcagccaaaagacaggaataatttaagtatccatcaacaggaggatctcaatagtaaatttcccaacctctgatatggcccagcaggcacttattaaaaagagggagagaaagtaagggtagagattatctttgtggggaagtgactggaaaagggcacaggagtcttctgaggtgccagaaatctctgtgccatctttcaggtgcttgttatacgagtatgctgtttgtgaaagttcattggtgtacatatataatttgtgtacctttatgtgcttcaataataacatcttaaaataataaaacaaagatttgggagatcccatgtgttagtggaaagaggattatactaggaaggagttctgagtcccagctccttttggcctcaactagcttgggaccttggacaagtcacttaggctgaatcacagttgagatgactcacctgtaaaagtgggcataattataccctgcatagataagtgggccagatgattttaatatagtttttttcgtttctaggctccacaactcttcaagccctattagttccgaatgataaaccaccagtaagttttttggatctatctcctcttctccatccctatttccacaacactgactcaggtccatatatcacttccctgggctatttcaaaagtcttcaacctggtctccccagttctagttttgcctttttataatccatgataaccttctggttagagtatcttctgaaagtctagctcagatcaaatcacttccttcttcagaaatcttagaaagcagtggggcataatgcaaagtgcacaggtctcactgtcatttaaaaacctgcgtttgaagagcctactggctgtctcatcttgtgcaatccagtgagcctctgaacctcacttacctcatatgcaagatgagagtactaataggaccttcttcacagggttatggtgaaaagactttcacttactagtgtgccaagtcctaagttacagtaaacatcagttaggggcccagaaggaaggcagagtaaagttccttagctaccacttcttcacttgctccaatcaaggcagaaaatacttctgggcagtctgagctgcaagacaaagctttctactcgactgactggctgtttgacaggagggcaaaaagtgaaaggcatctcccgctttgtaggcaatgccactgagagtgtggtgctttgtagcaaaggatgacagtcttaactgatggcaagctgcagcctggaagatctgtagtcctctctgcacacctaatgtggtaataactgcttaacagagacctcacacaaaatcaagagaagctgaaagcttgtggttgccttgctaatgtaatttaggatgcattagtcaatgtttctcaggctgttcatcctagatcagggtaattatggaggggaataaaaaaggccagattagaaaacagcttgccagcagaaccactgtatttgtatgaggtgatatgtgaatcagcatctgaaaacggtatgtagttatgacttgttgcctgctcagactttatgtcaagctctgaagcaaattcagcacttagtgttcatctcagagaaaaagcctggtcactgtggtttgtcacacaagcctcttgccagataaaaaggccactcatgctgggaatgcctctcacattacaagatttacacaatctccaggaactaatcttgggcaaagatgggatgttttcaacttgatctcttatctttccaataaactacaccaagcatcttctacgttttacctcctccccacgaagcttccttgaccgaccagaagaaagcagatggcttctttagctgcaccctaatttcacataaaatttcatgaaaatgcctccactcttcatcccaattgtgcacttgcactcaatcttctacctggcatagtgcctagtacgtaaaagacactcagtaaatatttgctcttatttactgagtgttcactacgacctgtcactctttcatagcattcagcataattgcaaataattgttagcgtagttatttgcttaatgactgtcttctttactagactgttagcatctcaaggccagaattggattctgtctcattcacagcttattgtggtaacttaaagcctaccactatgcctcacacttattaagactaaataaatattcactgaataaaagaaaaccaggcactaagcactatttattcgttttctcactgaatcctaaaacaaccctgtgcacttggtattattacctctattttgtaggtaaagaaactaggcttcaagagctgcaataacttgcctaaagtcagggccaggattctgaacacgtgctcttaacaactgttactctgcctccctctttcaaatctgcttatactatttattagttgtcgcctggaaaaatttcctatgttttccaagcctcaggtttttaaaaaatctgtaaagaagtggggaatggtgtctatcttacagatttcttgggaagtttgcttgagtttatacatgtaaagcacttggtcatagcggttggcatacaatcaatatttaataaaagctactgctgctgttatagtttctattgaatcaaatatgcagaagaatgtggctggagatagggaatgccacctgctgaaacctgccccctctcccaaaattagtacactctgtttctgcagttgagtatctctctaatggttttgtgtaccactctcatcacctcaccatattctacaaaacagcttgaacactaaagatgcttttgcttaaaattcaaatgcagaataagcaaaatattttaaaattaattatattacacaagcaattgctcaatgtgaaatactacaatctacatgacttaaattgaatagctcacattatggaggatatggaagattggaaaaaaatcaagactgtccccttagcacacaaaaagagggaatttcatcattatggatttttatttctgtagataatcaatggacatcaggaaatagagcagagaaagcagagaaagagaaaattgcaaattaggtggtctcttctttctgtgttgagatacctagagaggtcaacatttacacaaccactttaccatcttttggtctactctgttactgtcacttctgtcatttcagttcctaatagaggactctggacacactgtgtcacagaatactacaaatgtccagcattctgaatcacagtggcctaggtacatgtataatagtcctttgatacagtataattagctgcactgcttctcaagtgtggctgcatattggaatcctctggggtgctctgaaatagcatagacacctggccccattttcattttgatttaattgattccagacactgattttggagctatattgcctgggtttgaatctcacctcctctacttactattgggacacattactatttggacaaattagtatctgtgtttgtttccttatctgtaaagtgaggataataactgtgcttacctgatagggttgctgtgaaaatcaaataatatatttgaaatacatagtgtcaggcacacagtaggtgttccataggtattagctattagtagtagtagtaaaacggtattttaattgttatactttggtgttgtggaagagaagggaaagcttgtagagtttgcaaccacatgtgacaatgctgaaatggcagcagaagtattctgtgtttcaaatttataaaaatgaaatctcttcattgtaaggtactacttcaacaatagaggatatgagtttgattccatttggaatgtctcaattttgtacatgaagaagtaaaatataaatgtaacacatgtgtactagaacaaccctatttacctataccacacaatggactgtcattgccagtttcccctggtataaaaaaatcctaaggaaaagactttgaaaaatcaaaatcatgctaatcttaaacagtgatattggggattgtaggggtttggttcttgtccccacttgttgccattctgtggcgaagaagaaatttccattgtgtttgtggagggggacacagagtaccataaaaacttctctgggctttcacccctgcttgttctttggcacaggagcaagattgacttatctgattatcatgcctgtaatcccagcactttgggaggacaaggcgcgtggatggcttgagctaggagttccagaccaggctgggcaacctggcgaaaccccgtctctacaaaaaatacaaaaattagccaggcatagaggcatggcctgtagtcccagctacttggggtgctggggcaggagggttgcttgagacctggagttcaaggctgcagtgacctgagacagcaccactgcactccagcctgggtgacagagggagaccctgtctcaaaaaaaaaaatactaatattataaaaaaataaaaataagtacttattcatggcctatcctgtgcattctggctctcaggtctaaatgccctccaactcttttatgagtgagtagagcctagtcagggcacaggcaccatcttctagaggtagacctacaggcccattttgctcttcatttctagcttccactgaagtgtgacacaggccatcactctcaagggcgctgggacggtaaatggtctgctctgaaggctcactcatctccacaggtgagtatcaaggaatacatttgaagctagaggtggtaggaagtctcattaggccttagacacaagccatgttcttcaacataattttatctataataaagtcgatgccatattttgttcctcctgaggtgttttgtgttttttttttctcagtttgattcagaactggaaaaagaaaaccagtgtggttatttcatgctcttacaccataacaagcagagcagtaaccataaaagtattatctgactgcttttaagttgctttccccattaaacaaatttggaaactgaggcttagaaatggcttctgtggtccacctaaggccaaaagtctaataataagtgtcaaattcagtactaaaagcacagacttcagtatagttttcactacatgtctgagtgtgctcctttcccttattaaggctagcgaggaccttacaggtcccaaggacaaaaatgacatttgctttctgcactttactaagctaggaggagatgaaaacaacctctcaaaatgcaagaatcctcttactctgaaattcagttttactcacctaaaactgattttttttccagacaaatctttgcccaataatcacgaaattgaaagagattctctagacgaagttatacaacaaagtttaaatcactgatatagtttaggtatttgttcctgcccaaatctcatgctgaattataatccccaatgttggaggtggggcctggtgagaggtgttttggtcatgggggaagatccctcatggcttgatgctgtccttgtgatagtgagttcttatgaaatctggttgttgtaaagtgtggcgtctccccctccactctctctcttgctcctgctttcgccatgtgacatgcctgcttcccctttgagttctgccatgagtaaaagcttcctaaggcctccccagaagctgagcagatgccagtaccatgcttcctataaagtctgccgaaccgtgagacaattaaacctcttttctttataaattacccagtctcaggtatttctttatagcaatgaaagaatggcctaacacaaccacagacaaaacataagtataaaatgttttcctgcttgaatggagtggccttaagggtaggctgggatggaggacacaaactgtcccttaccaagtaatcaggtgtcacaaaaagattcttctgtaatttgctgagttgcccgagttctgctctaagaaagcaattccttcataggtatttcccagtctcaaactcttttctgtcttgagaacaaagtgccttcccctgtgcagcagccaaaacagatacggggcctcccataccaccaggtgagcttgtgacaaatcacgtagtactattagcatgagagaagttagcatttccaggttacagatacactttcacagtaaaaatgaatcaattacatgccacagtcctagccaatttgaaatgattatatgggtctggtaataactagttctcattctgccatgaattaaccatgtgaccttagataaatcccttctctgggtctcagtttcttcatttataaaaatgatggagtttggccaggcatgatggctcatgcctgtaatctcagcactttgggaggctgaggcgggtggatcttttgagcccaggagttcgagaccagcctgggcaacgtggagaaaccctgtctctattaaaaataccaaaattatccaggtgtggtggtgcacatttgtagttccagctactcggggggagctgaggcaagagaatcacctgaggcttgggaggtgagctgtgatagagccactgcactccagcctgggtgacagagtgagactctctctctctcaaaaaaaaaaaaaaaatgctggagttagttgaggttgtctccaactctaaaacactagacttaaacatctaccactagcctctatattaccaacgtatcaggctacttacacttcatgtctgctgagagaattcctaatgacttaagtacaatgaagtcacaaaatcattccaaagctatttcaatgattcgggcaacttaagagagatgtatttccatttttctatcctgcctcttttgtgccaccctgtctgccctcccctggacagtccttgaaaatgaaaacttcacactggatttcttctatcagacctgagaaagaaagtaggcttacttttttgatcctccagttttcaagataatggttttatttcttgaagctgtaatcagatgaaaatgtccaaaggactaaagaaactgagtagggctattagtctaccctttttcttattttaattctatctgagggaacaataggctcttcttgcctttggcaagataataattcagctgacatgctagaaataccacacaccaagatataaaatggtggcattttctctctttaaaaacaatcaacgctttcatctgtggacttcaaagtacacatgaaataaaaagtctcagtcctgtgagtctgaggtaaatcaaaaggctataagtgtcatagaaaagtttcctggttcgtagccctcctttcaggtaagaaaggaaacaaaagtactctcaagcagatgagtgttcatctcctttttatatttctcttccaagtgagcctgaacaagttttctgataacccattctgataatagttcttctttatggctgaccaaatttcttcttgctgctctacaggcccactttctcctattaatctagccttgtagtgctgtaattgttcactgtctttatattgtcaagtatcattttgatttccagaatttctaaaggaaagctgagaatggagttgggaggtctatgatcaagactggatactctctggaggtccttatttaattataacactcctggtgatgctagtctaccttagataaagttatttctcttctctagtgattagcacctcatgtgtaaaacgcaatgagtatgagaatacattaagagaaagaaacaatcaccataccaatacaaattattattgattttgaagggtctttctggagatcttgaacttttgtgattaaataattattgcaaatgaaaactggctgaagatccctcttttcacactgagtcattcgttattcacatgaacttcggcaatactacttttgacgcatttaaggacaaatctatctttcaacccaggcttatagagaaaagacaatggaaataggactctgcccacacctggatgctcactttggtattgtaattattcctgggtagtttcccactcttccagagagctgacaccttctttgaatattattgtaccatgatgttgcttaaaacaatgcattcgattttagtcatcatccagttggccttgttgactcatggttttttccactttagtggaagtatttcatgaaagagttggtatttctgcttctacaaatccagatggctctcaaaccaggaggcagttggcaactttgagaaacgaacttggcattgtgattttacatgggtttaacaatcttctactcttttgctatagagtaccatctgaataaatggatttgctgccatcttagacaatttgtacagctacagcatcaccaaggaaacatttccatggggaaaaggtaaaatttaagaggaaacacactctgaagaattctgagctcatcttataaaagctacaaagcaaccagatccacaaagaaagattatgtggtcaaatatggcagtaatgtctaatcctgattactggtctacttcatagttgaggcaggacatttaaactctacctatcagtttcccttgggcacttaagaaatctcagctgtaataaggcaaggattccattagggccaggtatttttttttttcacaagcacccagatttgatttgtgcctgttctaaggatgtaatctcacaaatgtctgagtagcctttagggacaagtgaagctgtcagttggtcaaattcagatacaaaggcagagtttcgtgcaaagctctatcctgaaaataacaagaaaataatagggaatataaaggcatagagaaagcaattattcaatcaaatatgtgatcaagcaacaaatatttctggagcatctattttgtgtaagacaccatatctctgctaagagagttggggcccttccaacaggggagttataactgagttgaaaagctaaggcatatatatatatacacaaactcataagcaatagttcaaggtggtccacaatcagtgtcaagtgattgatatgaatttaatgaccgatatatttcagaggtacaagagaacatttctaattaagatgatccagaaggcttcttatagagggtaggacttgtactaggcactgacagttggataagactttgacaagtgaaagaagaaggggagcatgctgggaaagggaaatgaatggtatgagcacggtggtgaggtaggtaagcacagtgtcttcagagaaaagtagtggatcggtgtggctgaaatagaagacttgttttggggagtagcagaaaaaaaagaaagctgaaaagaggaaccatgagatctgagtttgaagggatcctcaagattatcatatccaaggcctgctcctcttattcttacctatttatttccacataaacacagctttccctagtctgcaccaatgttttacatacattttagtggtggttctagattcctaataactttagacacagtaacttcagcatagtagttagaaatagactttggagttagaggcctgggtaaaccacttgctagacattcaactttgggtaagtttatcctttatttcttcatctagaaatgtgggtaatagtatacttacagtcgagggatgaagaaaatgagaaagaaggcttgaaggagacagtaaaggaagaatctgcaaagtgtattaccaaggaaagcaaaagtagagaaaatacaaagaagggggcattgttaatagcatcaaatgaaacaaagagttcaaggtggttgcgacctgccaaaaggccactgactttgacaatctgaaggtcacaggtgacctttaagaaatcagttttagtacaaaaggaaagaggcagtttgtagaaaatggaagaggtaggagggttgggaaagggaggaaaaaagattgtgtagtgtggaactggatctgcaagcaaatatccctccctcgtttgcagggaaggagagggagagagatggctttgactcagtggagttacagggccgagtgatgcaatgactggacatgcagcttggaaatgaaatggtcggtagctcctttgggaacttccaactctagctttcctccttgccacagtgcagggaatgatgacaaaggaagagggaagttgctactcatgaaatatcttccctcttccttttgtctagtactgcagaggaacaaaataatattataaagctgtctgcctatttacaatatcacaagattgctgctgaacaattataaaattgttcaagtataaattatacaattataaaagactccttgtatagtaaaatctcattaatttggactacactaatttggaatttgtggtaatttaacctgggttggagttacctttgtcctactaacaaagaaaaggttctctaagcaaatattgaacaagatttcaagggagctaatttagcctgccaggggcttatttcacttattttaaagaacatactgttttttaagaacttcagcatattcattatttgaatgcaaattgttctgctaattatagattagcataatctactgttaaaatcctatatgtgcaagttactttgctctcactgaatgtgctcattagaaataaaactgcaattctttaaagttaattcacaattcagattaatacatacttcctttccccaccctcatgagttaactgcagttcaggaggtattaccctaaactcacacatcacttaacatcacttaacatgaatacaatggaaaaactagtaggtgatcataaaagtctcagagccagaagagatgtcttaaagttgatgccctaaattctgtgcactctatccgtggcaggttccacttagagctgatttaacttttacttatactaatctggcacatcagcttggagagatggctgggttttgttgttgttgttgttgttgttgttcttaattcagtagaaggagaaaaacggctgctacatgaagggacgatgagaggaataaaaagtgactgtaggcagcagaaaggagacaggacatgtgtaaaatgtggctataataactaaaagaccaccgcagcgtagaacaatttagtgtagaggtaaaaaacctatactttttagtaaacccttaaaaatttaaaagtattagagtgccgtacaataactaatgactggaattacgcccctaaatgatcaagcaaagtttaaattatattgaatacatgtctttaaaagacagatgagtttatacacatacacacatatggtttatactcataatgcttaacctaaaaatgtgaaacacgttgatgatttaaaacatgaaatttataatatcatataataatgctaataaaatagtaacgtttattaagtgattactgtatgcagacaccatgctaagcactttacctacatcatttcaactaactgtcataacaaatcctaagacataggctttagtatcacttttactttacagctgaagaaagtgactctcagagaggttaagcaaataactccaggccacagaaagagataaaaccaggattagaactcaggccagttccttggctatacaccatgcctttccatgctccagaaaacagagctctctaagaatcactcatttcttgagggttccatgtaactaatgttttactgtattttcattttccaaactcatatttaacaaatatcttgatttataagcagagatctatgatctaagagtcagatatgatacatttgtaaacatgttccatttcacaagctgaaagtaaaaagtaataataaaaaacaaaacaaagaaaaaatgatgaacatgtctgttatgcccatccccgaatctcagatcagtttctatatactacagattctacttccaaatgaataaccatgcaacaaagacataaaattgtaaaatatcaaatgatcagttaagatgtggctctcctatggttttctcactccttttggaaaaaaaaaaaaagaaacattaagatgagaataggccaatgggacatgagggattggggtaggagaaattgcaagggaggctaaaagctccattgggctgttatagagggtttagaagaatctgtttgccaactgttctaagagaattataagggcataaaacatatgtaggcatagtgggtattgaggggaacaggggtagaggtggggagatgcaaatatatgcagctatctgtattagaagtaaaagtgaggatggcctgccacatgtacatacaaagacaaatgcacagtgaaaccattcactcatgcaattccttctacctaaatcgatgctctttactcatctcttgtctcaagcctacccattcttcaaggatcagctaaaaatggcacttctgccatgaagtgttctataatccctaaggcagaattaaactcttcctcatttgtgctctcatcggtttttcaccctttacacacttgccacagcactgatgatactctatctaattatcacagttattcgtgtatgtgcttttccctccttcaatcccataatgagttccatgaggacaggggactctttctcatttatttagttcctacaagctctagcatagtatgtgacctgccacatactaggctctgggaaaatgttgactctggtactggcttaagacagtgcattatcacctagcttacctgaaggagtatttgttctctttcttttcttgcttgattcccctccattctcaatgaggccttctgtgaccagagggccactggcactaccaaactgcaggggctcgttgttgttagcagggtcaaagggcagctggttcaatcctaaagaagaaaaagaaagccaaagtccagactccattaaggactgggattgtctccagattttattatatgagccactagtggaaaaccttttaaatcttaaaagcctaggagaaacaggtgaattccttaaagacagttgccttctgtaatttttacagatcttttcggtaagtacaaaattaaaatataagactgtggctctgtcatttgtaagatccctcctgtttctgcggcaacttaacatttttagtcataagctagcaactgataggtccctcattaaatgtggctatggttggacccactgttccttgtaaaaagtttggctttgcattccttggattatctcctgacattttaccattctttcattacaaggtatgttgatctcatgcagatataatcatcagactatcctgtgtcaaagtcacttccaatagtaatataggggtctctaaaatcagaaaaccataactccatggcaaatgagaaaaggaaacaaatatatagaaattgcaagggggttatttagtagctggagcaatggggaattatgacctagatttcggtaatgttaatctcattctcttcaaataatattagaagcatggtcactttactcgtcactgctgcaccatataaaatggcaaaaggtattttctactctccaagtcttacatggttcaatcaggggcaagcagagacagagacagttcttactcctctggcagcagcacctggaatttcaagtgtttcaattaaacttcatgaaatgtgaaatcaaaagcttttttaaagcccaaagttaagacatctcctgtaagccttttctccactggttctctaatcctatcaaagggggggaaatcaggttggcctgatatagctcactctttttttttttttttttttgagatggtcccttgctctgttgcccaggttggagtgcagcagcatgatcttggctcactgcaacccccacctcccgggttcaagcgatcctcctgcctcagcccccctagtagctgggattataggcatgcaccaccatgcctggctaatttttgtatttttagtagagatgaggttttgccatgttggccaggctggtctcaaactccttacctcaggtgatccaccagcctcggcctcccaaagtgctgggattacaagcttgagccacggtgcgcagcccatagctcattctttaactcccaaattttctatggcccatagctgtacaattcttgaggtaatgttgtaaattgtcagttaaaaaaaaaaaaaccttgaaatccagtcagctaaaggtcaatcaagtttcaataaaatgaatgctaagattctaatgggctggcatggtggcttacacctgtaatctcagcactttgggaggccgaggcaggcagatcacctgaggtcaggagttcgagaccagcctgaccaacatggagaaaccccgtctgtactaaaaatacaaaataagccgggcgtggtggcacatgcctgtaatcccagctacttgggaggctgaggcaggagaatcgcttgcacccggtaggcagaggttgcagtgagccgagatcgtgccattgcactccagcctgggcaacaagagtgaaactccatctcaaaaaaaaaaaaaaaaagaaatgactttaaattattatttataataaagagtatcctcttgctaatgttttcagcccacataacaagtactgtttttcagcaatcagattccacttggatcacctccattaaatgtcttctggaacttgtcaaacattcttccttacatcatgtgagtaactaagtgaaagagtaaaacttgcttctggatcttaagcgaactgttcactgcatcatatacatgttctactaaatccctaccatgactagaactaaagaaacaaacatcaattgctatgtactaaaaaaaaattgagatcatgaccaagactatttaaaaagaagactagatgtttattccatttacaaatgaagattgttctcgtacctgattagtcccagagtcaaatatgattaatatactagtccaaaacttttcttggaatttctttctgaaatatactgatcaaaacaagttccatggaagacagaatggcatagtggaaagatcccgacagaccgggattcaaatcctggttatcctttactagctgataccttttggcaagtcatgtggtctctcttagtcttggtttcataatgtgtaaaagagagtgataacacacctaaggctgtggcaaagataaacacatacatatttatgagaattacattattctaagtaaattaaaacaaactttccccctataaacttgaaagctctcctaaaaaggaaacttccctctctccctccctcccacaattatattcttggtgcctagcaccataccttgagcgcccaaatgaattaatccttaattggatgggggtagatgactcattcttttaacccatgtaatgaaagacctgacagctgataatcaagaattaatgccacagcttaaaagttctgatgctgattatatcaacattacttaaaataattagattctaagtgcatctccatcatttgagtactatactacagaatggtaaaatgctgatgaaaaggaatgttcagggattaggaggttctgattaatgacggtgaaacagaaaaactttttttttttcttttattattattattattatactttaagttttagggtacatgtgcacattgtgcaggttagttacatatgtatacatgtgccatgctggtgcgctgcacccactaacgtgtcatctagcattaggtatatctcccaatgctatccctcccccctccccccaccccaccacagtccccagagtgtgatgttccccttcctgtgttcatgtgatctcattgttcaattcccacctatgagtgagaatatgcggtgtttggttttttgttcttgagatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcaagatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgaaacagaaaaactttttatttttgttttgcatttgataattttacagaataacatattagtccatttccctgacttattaagtagatgactgaggattttccggaggtttggagccacaatttgcaaaaggacattaataagagtacctaactcacaagactgctaaaaatattaaatgagattatatatgtagaacattcagcataacatctggcacatagtagatgttcaataagtattaactactactattataacattgaatttccatttttaatttctagttactgatgtgcaatgtgaggagattgttctgaatctgccctgatccaaggatgtaccctgctttcctcattgaaccttttcattcctgtttgtacctttttctaaaagttgaaggaatccaggggaaaaaaaaatctaatgagttaaaggtgttcagttatagacattttattataattatgcttgccctttctttaggcccatatggtaaccttagggatatagttattttattaattacatggatgtacagatttttggcaccaaattaagactgagatttcaagtactttctgtgtatccacctcatatatgatccagatatgtgaaaatcatgacaattcagtacaacatttcaggcctaattttttttatagagaaagatctcatatggaggggggacatctcactcagtaagctgactcgctgaacacaaacccatattttatatcatccaatacccaatacagtctccaaagatttgtagttcaagaggaaggatgaaagagacagcaaaatcctatgacaccagtgcttcctagctacttttactgttttgtttcattccttccataagacaggaccaaacaaaccaataaatcagtaaatcaataggtatttaaagggtgttttttgtgtcatgtatatgtgacccaggtcaaatgctattttaagtaaactagtcccattaaaatgattaaatactaaaaaagaaaaccaccactttaattccaagaattcttattgctgaaatttcaattatgacataaatataaaaatattggcaattaccatattgtaatcctcacccaaactacagaatttatctttaaatctcttatggaagcaatttctaccattttttctagacatgatgaaactgaaaaatattagatttggaagaaagttttgaggttatctagtttattcttctatttctatagaaattttatctatagaattcctgacaggcctaaatccaggggcactgcttcgcctgggactcattccttgctgggctcccaggcattcagcttgcttttaaaaactaccacctactctattttgggagttccttttatttccctaaaacagcttcttgcttatcttacctaaaatgaagacataggatgtataacttttaaaagtttctactgataatcactgtaagaaaaacaaatgacagagtaacagataactaacaaagtcagaaattgtccaaagtcttacgcattcctcacagtccttgcccttttattcctaagaataaatttaataaaacctcatacttcgttcatttgtttccctcacatctcatctcctccctccagcccacaaaatttacagtttgtccaaagggaagtacaaattattaaaataaagacaaatagataataaacactggtgttacagatttctactatttctgtatctcatgttcacaataaacaaatccatgtggtaacgtaatctcatctaaaaccaagttgactggtgtagacagctgaccagctgttatttcatgtcatgttgaaatgcagattatctgactccataacacgtatgaggctgctttagaaagtatgtatattgggaaagggtgggggtggggttccttgtagaatgacatttctcatctaatggaactagggggttaaacatctcagaatgaagtgtgatgctcagtgaatactccaatctgcaggtcaaggagttcacaagcaatgttatgtctgccatacagatgcaaatgattcgtgggctttgaggaaagcactaaagaattttcatgattcttgtgtgagaagatcaataatctctttgtgcccagctgctttaacagttactgtcacaattcactttacatagctgtccactatcaggtcaaattaggaccaaccttcatgatgcaatctaacacttttaatgattgccccaggttgtaataccaaaatgtgaccctgtgagtgaatgccactttttatctgcagctgtggctcagagactgtataaccctagcgaaaagaaacacaatgccaccctggattagttagctttaaaagaaaatggctaaaatcttgagaaatctgataaattcaaattaaggcaacaatctcaacacataaattaatgttgaaaaaatatcagtacttggcaataagaacagtctagctaatttgtctgtaaaacaagtttctataacctaattcttattttccaaatgacttcaatttaaaatcagatatgagattccatgttgggagatgagggtctccaaatttgttttcaattcaaaacttttggaaaaataagggattaagataatggccaggcccttaatgttctggcaggtgctgttgaaggatttatccatctctggagggccctcctcactttcattcacccctcctgcttcctcattctaggcctcaaaaccatatttgtagctctcactacccaaccattccacctgctacttctgagggaatatttacaatgtccaaaagagttggaccgcaatattactcttcagccacagggcttagcagccaagacaattgaacatttctcagtgccaggtcttaactgatgtcaaacaaatgaaacctactttgtcaatttcatgagttcaatattctaactggtttagctgaagcaagggtaattgtatgagttacaaataatgggtaagtaaaggtaatgaagaagaagtgagaaagaaaacggaaaagtccttttcggaagcactaaggggcttgcttgaatggtggtagacaaactttcagagcctaatttatctttaagtcaccattttcaaggtgggatacaggtcatagaccaattttcattggcagtgatccttcagcaacttttaatgactccccaaactacttggtcaagtcactaaagtctctcataaaaaggccgcatccatttcaggccttgtctcccactatgccccagcttatgctctaccctaatacttctcaaactttttaatgtggacatgtgttccctgaggatcttgtaaaaatgcagattctaatttagtaaatctgagttgtggtctgcttttataagttcccagatgatgctaatcctgctggtgtgggaatcacattttgagtcaaaagggctggcactccagcaaaatggaactacagcattcactgaatccatccagtactttcctacctccacacctttggctcacactgctcctccacctgcttcttaattttcaatgttcaaaatatcatccttcctttagggcttatctcagatgctatttccttcatggtgtctttccttattcacctctacccaaaccaatacatacacagcaacagagagaggggaactacccatcagggaaactactattcattggttgtttaggatgtgcttgtttacaaacattatccctttattttattttctaattattattcttattttacaacaaggaatgagaaacttacagagttgaagtaaatttcccaaggtcacacaaggaattcaggctttttgtttttcctttttgtggtgagcagggtctcactatgttgcccaggcaggtaactcctgggctcaagctatccttctgcctctgtctccctaagtgctgggattacaggcatgagtcgccgtacctggcctcaggatttttttattataaaatactattctggctgtccttgaatgttagcctatacttttcctgagccttttagagcatgccttgtgttacagttctttgggtattctgtcttagcctaccttcccttctgccttaccccactcccacttagtggtaaactccttgaggacagactttatgcctcagtcattttttagtctctcctcccccaagacgtggcgcagtgccttgtattatattgtaagcactccagaaatgagtattgaactgaactcagctacaatttgggatacagcatggatagtatctgacttacaatggttcaacttacgatttttcaactttatgatgtaaaagtgatagacattcagtagaaaccatacttctcttaccacgctgggcagcagtggtcagctgcggctctcagtgagtcacaaatttttgacttatgatattttcaattttcaacgcgcttatcagattgtaactacatcataagtcaaggtgtatctgtagttgtgtttcccatcccaggcaccagctgacctgctgctggagttgtcatgaaaggaagaaggaagtaaggtttatgggttccttcagcattcctggtatcttctgcatcttaggattcctgaagcctggggagtgatggtagacaatcacacactccactcctaatgtatctgcataatttcattctctctttctgaagggcaaaacagtccttccattgaccaagaccgttacctgagagaatactataaaagagatcccatatatggatcttctgttaatcgttctatgtacatcaggttacatgtcccatttacaaactacagttaagaaaaggcagtctctatccagtctaccattgatgggcatttaggttcattccatgtctttgatatgtggtacatatacaccatggaatactatgcagccataaaaaagaatgagatcatctcctttgcaggaacatggatggaggtagaggccattatccttagcaaactcacacaggaacagaaaaccaaatactgtatgttctcacttataagtggaagctaaatgatgagaacacatggacacacagaggggaacaacagatactggagcttacttgagggtggagggtggaaggagggagaggatcaagacaaataactaaagggtactatgcttaatacctgggtaatgaaataatctgtacaacaaaatcccatgacatgagtttacccctataacaaacctgcacatgtaccgctaaacttaaaagtttttaaaaaagaaaaggcaatctctggagatgtgctatgcaatacagtagccactagccatatgtagctctttaaattaattaaaatggaataaaatgaaaagttcaggccgggcacagtggctcacgcctgtaatcccagcactttgggaggccgaggtgggtggatcacgaggtcgggagttcgagaccagcctgaccaacatggtgaaaccccgtctctactaaaaatacaaaaatcagctgggcatggtggcacgcgcctgtaatcccagctactcaggaggctgaggcaggagaatcacttgaacccgggtggcggaggttgcagtgggctgagatcacaccactgcactctagcctgggctgacagagcaaggctccatctaaaaaaacaaaaaacaaaaaacaaaaccagaaagaaagaaaaaaagtgaaaagttcagttgctcagttgcactaatcacatttcaagtgctcaatagttacatgtagctagtggctgctgttttggacagcatatttatataacatttcaatcatcccagaaacttctgctggacagtgctgctctagagtcagatctgcattcaaagccacatctgcaacttactaggtgtgccacttactaagtgtgccacttacaaggtgtataaaacaggtcacttgatctctctcagactgtttctgcattgtaaaatggggatgataatgccccccttacagcaaagtgaggaaaattaaataagagattgtatgtttaaggtgtagcacatgttggacactaaacaaatgtcaatgcccttctaacccaatggggggtttatataaatttgtctcaaaaatggaataagaacatttgagtagtgtggctccttcggcctccaggctacagtctatttacagcttggaagatgttagctttgcattcctcttctaacctactttttcttaataacacaaagccattaaagtaaatcatgaataaataatgcgggagtagtcagtgattgctctttgcttggattctgtttaggagaccatattcatcactaccttgaactgtccaacatgaaagaatcacattttcccctaacaatggaaatgtctcctcccaaatctttcaggaatgctctgttccatctgggtgctgtactatcagaacactgctagcagtgatactacagctggactagagagagtatcatttctctctaaatccatattttcgtacactcataatgttctctgtgttttttctgtggggctgacatctcccaggcctggtaaagggtgaattattcgagaaaagtctgaactaaatctgttaaggtgtttgtgttccgtgagcagaaaagcaaaatacatatttccaacttcaagaagaagaacacttcaggacttttttcccttgtccaatttaaggcttgggaaacacagcaaaatcacattcctcattgaaaacaaagttcaaaaaaatgttgatttgatagaacagttcaaagtgacagatggtagatgggtgatctatcattttccttagaataaagtctgtctggcagtcttcagaggaactgagaagagaaagccttattttgttgtagtttagccctgggaacagttacagcagctaccctttctctccacatcttttggggtaggggattggaaagatggtgattcatcagtgtctgctttgagctggctctaggccatgctgtaattcctgttgaccaattttccacctgagtgacaggaaaagggcaggttcctagcacactgaccattaggttatctgttgagtacttccctgagaatgtgcccagaggtactctattatggttgtctctgtctaaataaaataaataattgcagatttcagagcctgaggacagagagttgttctagtattgaaattggagtctatcttgtcagatctgtaatgaggtcttcccttcaggctgattgatttcataaaactgaggcaattatcaaaagcaagcacagttctccctgcagaaaccacttcactggttttgaaaactagcttgtcagccagatctggtcaggagcctaggctgagccagctctttaagtaggaacagttactacacacagagaacaccaatttctgctaatagattattaagatgccagtaaataagttgtaaacaaggttcagcaaaataatttcacatgctgtgagtgaatgaaaattgaagttgctgtcaaataaatctgcatttcagtgtaagatgttttgaaggagaaagtgagagctggtcttttggtctttggagagttaattttatcagttaatgctagaaggatactggtatcctttaagactgatgcaccgcatgaataacatttgtatctttgctttgcccaaaatgtacacaccaatttcaccagatttcctttctttgtttattcagccttcattaactatttatccaatcactatgctacaattttaattatcttctaattaaccaatgatgagtttgtggtttagcattccctaaagatagaaccacataaatatggtcaatcttcatttacatattcaaaatttttatcctccctcctggctcccaccctattaattttgctatactgcgtcactaatgttctggaattatgctttctgcattcctaatcttttagccccatttgggctagtttttcaagaatgtatgagaaataaccctcgctgttggctatgaaattaaacacacaggagaaaacagagcttcctgtaatatgctaatgcatccttaaagatccatacttttcctataacaatttctcctaggagtatcaatacaaggtgttgacaactgattaactcctttagagaagtccctgcctaagctgaagtcaaacctaccactaggaaaaccagaatctgctccttgagaagacagcatgactgtaaagtaaaaagcctgcaaaaaaatcactaatctgtgtctgaaacaactcctaccattgctgttgtataaaaaaaaagtaggatcttaattttgctacagtctggattttaattgaggtattcaatacatatgggaataaacaaaccaataaattaatattgactgatagtctctctctttatttgtccaattcattcaaacaattctgggtgccttgacagtatgtaaggcttgagaattttaggatttaatatgatagttttttttcctcaagaagacaacaaaagaaagaaaggcagatacatacaaagaaaatctggcccaaattactgtaccagcttcatctcttgccaattcccctaagtaccctttgcttcattcatgccaaaattctcaaaattcctcaaacatgctaagccctgtcatgtctatgtgcttctgcacataccatctcctctgcttgacatataacttttcctttttccacctggagaacttttattcatccttcaaaactcggctcaaatgtcacctcttcagtgaagttttacctaacccccaaaagctctctccacaggagtacacagagccttatcagacgacttattgtaggatcttagagttcattctaatatgtgtgtgtgtgtgtatgtgtgtgttctgggtggggggctgtcaccatctgatttgtgccttagaaagaccactcctatggcatgatgaaggatgcactgaaggtgagaagacaccagaggcagagagaccagttagaagaaaaccataatgatacaatggagagatgacagtcgcatgaactcagacagtggcagtgggatgaaaaaaaatgaatggatttcagagatattcaggaaatataatcatctggatttcatgtataattggatctgggagttgaggagaagagaggagtctgagatgactccatgaaaaaattcttaagccacagtcctgaaaatcctgcaacatttgtgggtttcagtatgagaaaaagcacagtccaatagaagcatatccataaatccatgctcaaaaataaaactgcttccaatctctatttaccatggcataaaggctgccaggaaacagcagtaaatggcttacacttgacctttactaggtattcttaacaaagcttgtcaaaagatattaattcattcagaaaaaaagtataattgtctaagaggcagaataacatagtattgggataaagatggggaaaagcattttcataataggtctcagacttggtttattttgtctatagcattcactgacaaaagacaaaagtatttttgaaggtcagaaacacttaatagattcctttgctttctcctttcatccttctcccttccctcctcccaaacaactccttaaaattttattagaaaatcttaacattttaataacagtattctttttgttattatagtctgttggattaagttaacaattctccctttaacaatactcaaagaaagcctggaaaaattaatgctatgttgtttttctccctgccaaagaatatagcaatgtaattgtctcctggagaagaagcactctaatcatctttaactttaaagtaaattcatttcaggaagatgctctgtgacaaacaattgacagagcaaatcagggctcctagaagattgcaaagtgatggattgagttgaagagagtgccacagctgaattcatgaacattttcaacttaagagtgtctctgcaacaaaacagcactgtatgagagttaaaatcatgttacattacattgtgggaggtaggacttaaacactgcacagattcttaacacctaagagttctaggcactccagaggcaggaaaagtataagccaatttctctgattaaaaaatagagaaaccattgtaccaggcaaagtcagactgtaaaagcatagtaactttccaaaaaatgccttaaagaagttgagatcagaaaagaccaaaacactctctcaatccaattgatgtcactaggatcttggaatgggtctcaatgccaaggtattactcttatttggaagatcatttccactttcattcccttcctaattgaatctgtctccatcttccattgtgtttgttccattattattttttagaccctcccgccccgccctgacattaggcttggggaaacttatcctttggagaagatttggattagtaaatttacaggcttgacaaatttacaggctcagaatttcctggaaattggccacttgcctgagatgatgggggaaggagaaaatggaagagcaggtgaactaaggctcttgaaaacttgaccgagcagcttggcctcctgagcagatgcaatgatgaccatatagcagcagtgcagaaaagcaattctacttaaaggtcctttctttgggcttttaaaaggcaattgttttctttggcacacatgtgacccaaatctggttttctccaaagtaaacagaggcaaaaaaagggctcccatgttctgtgtgtgtgtgttgttgttgttgttttttaatcagcctacttgcttgccccaacccagggcccaacataatatatttgtcaggagtggccctggaggagatcaagactttaaggcagtgtgtcttatccctggctacatattaaattcaactggagcactgagaaaaaaaaagacaaaaacaaaacaaacagaaaacaatgcctggactctaccaccagaaattctcattaaattggtcagggtggaacctaagcatctagtttttaaaagccaccaggtggccaggcatggtggctcacgcctgtgataccagcactttgggaagccacagcaagatgatcccttgagtccaggacttccagactggcctgggcaacatagcaagacgtccatctctacaaaaagtaaaaaacaaacaaacaaaaatttaaaaagctaccaggtgattctaatgtgcagccagaattgagaaacacagttctaaatagttttctaatttaaagccagaaaatgagtattcgctgtccaaagtttatttttattttttaaagttcaaaccaggtaacacttagaaggtaagttaattaactctgtacctacaatctgtagggaaaggtattggttgtgtggtataagtacgttagacttaaacttgtccaatttatgatacttttatgaaaaatgagattctcttttggaaagaaagattagaagggttactggaaaaacaaaaagaactgaaatattggaaacaaatttagacaaagtataattacaggattaagttccttaccttagttctagaagaaccagataaaatacttcagaaatattgtgtctgttttcttattaatttccaggagaaaggttccaaactgcccttggggactggctttgaatctcataacccttgggactccaggccactcacccctgtcctcaagtaatcattcatttataccaatatgtgtacaatgtcatgaagaataccggaaagcactgcaactataacaccattggataaaaatcacactgaatgtggtttgccgatgtcacctgtcacctcagtaattccattgaactttagaaaggatctggtaaaatataaaaaatgcaaaggcacagttaagtgctgtgatggttaatattgagtgtcaacttgaatagattgaaggatacaaagtattgttcctgggtgtgtctgtaagggcgatgccaaaggagattaacatttgagttagtggactgggagaggcagacccacccttgatcttggtgggtgccatctaatcagctgctagtgcacctagaattaagcaggcaaaagaacatggaaggactagactggctgagtcttctggtctttatctttctcctgtactggatgcttcctgtccttgaacatcagactccaagttcttcagcttttaaactcttggacttatatcagtggtttgccaggagctctcaggcctttggccacagactgaaggctgcactgttgacttccctaacttttgaggttttgggactcagagtggcttccctgctcctcagcttgcagacggcccattgtgggacttcaccttgtaatcatgtgagtccatactccttaataaactcccctttatatatacatctaccctattagttctgtccctttagagaaccctgactaatacaagtgtagtggaagaacaggccataaagatgcaggctgtggtctctgctcttccatcaactcatagggtaaccttgggtgagtaattctttgtcagtttcctcagctgaaaaatgagttgaaacatgtgatctgccagctctgaatttaagataaagaaagaaaagcttagatggaagacatccataaaagcatgaaataaaactcagtaattaataggggcagaaaaggagagcagggagaacagggagagccctggaaggatgctttcctagtaccacctacacaaaacttatttagcaggcagtaaatgatttaatagtagtacagttaaggcacccccccaaaaaattaaagtacttctgatgctgctcaaaaaaaaagcctttttaagaattttgctaattataaaccagaacatgtaaggaagcacagaacagtttttttttaatgatgtttaaataccaatatatcttctaagtaacttgccatcaattaatattatttacggaacaagcattatgaaactcagaagaagagtctaacgctgaaatgctaaaagtatgcccagtatggtaggaataaattaccctaattgaccaaagctacgctcacatgtgagacatttcaaaacacactgacataatgacaaaaattcctgtctctctctgccaatgttataggaattgttattaaagccaagcatggtagttgtgtacacataaaagcaagcaaaaattataatctagaggtttttaaatttaatcttttttatttattagtattgttatacagcaatgagtagtcaaaaaaaaaaaaaaaactaatcagcgtgcattatgcaacaatcagagaaaatactcctaatcctctgtcattctttttccttggcccctgggtactcattaaaggttaatttatttaaatctcttcaacattcatttcaatctactttaataaactaatgaatctttggaactttgcctaatcagcttatgttttctattttaatacatctacaaaatgtctttttttttaagctccttcttaataattgtcttcccttttggagatagaattgtgcttcagtgacaacctgatttgtacatttggtgacacatttacaacctcatccagcacacagggaatagctgtggcttgcttattgttcttaaacatagttacattttagaggatagtgaattgatttgtgtttagtaggataataatcctccaaattgaaatggtcattttacaatttagtaagagtgacaattacagtaaagcaaagcttctaataactttggtgcttgtcaaatgctatgagggtctatcaatgaaacaactccattctggttattgtaaaccagagcaatgtatagtatataccatttggattggcaaatataagtgaagtctggagatgtcttcaaatgaatagtacaatcaaaatggcgtataaaatggttccttacaatctatccaatcactatgttcaacacattttgtttaatggcaactttgaggaatctttcacataactatctttaagttgaatattcttacggtggtggccaatggtcagggactgcacgccaccctctacaccagaatgccagaaaccaaagtcttggcgtgctagcacattatttctaactactgccttaacaatatctgacatcatcctagaataacacggcttagcaagtgcttccacaatatccttatggtgggggaagggggaaggtattaatgttgttggcttgtaaataaggaaattgcagctcagagaagcttctgtatttccaaaaggttataatgtcaatatgtggaggagctggaatccagatttttgggctacaaatctttcctcctgtaccatgttgcctgcagagttgtgttcggataaatgtttttactgatccatggctcaccactgattaaagaaaaagtgtaaatgttacctttaagatgtcctgatgaggaacaaataaaattaattaaaaatatattatgacaaattattcaatataacataacttcataataccgtaattcatttggagcataactttacacaaaagagatgaaattcttaattttcagttttattttctatacaaattaataaaaataataaacttattcctcacccatgatctgaatttcgggtaaatttctaatggaagtagatacattgtcaaatgttttcaagttatcacctccgattttccaaatagaaactccaagaattacctttcagatttcattgttcattcattacacatctctctacccattcattcattcattcatccaatcatccaaatgacatttacggaatgtctactttgaggcaagcaaaaagtcaaaggtagactctacctgaagctcttgctgctgctttacttccctagactatgaactccttgaagacaggggatcctgttattctacacagaatataatcagttctatttgcagaaaatcacttaaatacttttttgacagtgagatttctggctccccctgccgcccacatgcccctccagacatatgggagttagaggaagaaatagcagagtctgcttatcaagtctgacctttggataatgactatagttctcccatctgagcttgctgctgttctgccttgtggtcaacaaaatgatttggctcaaaatggcaattcatctgttgctgcttcccagatatcctctagcaagccacattattttttttaaaatggttgcttctgcccttcggcatagaggtgaactgtatcaccaaatatattgtcttgcttgatacagtgagaagctggggtttacagaaaagatgcagataaacatgaagcagccgcgaaagaagaaacattcgtttagtgctatgactaaacaaatgcttgactttattattttaacaacaataatttatattcagagactgctattatcctttcaactttgcttcacatccacctcacagctactttgtgaggtgaccagagaaggcattattacaaagttaaaatacggaattctaaagctcagagacgctaaagtgacttgtttaaagttccacagcaagccagtggcagagtttggtctcccaactaacactccagggatcaggcttctctattaggggtcctagtcaacaggagagttgcatttttaataattactaggagccatgaagaactaatccattgtttcagtttgtactattgcctagttaattatttagaaatgatttattaaaaacaagaagtgaggaaaccatcatgctaagcaggcaattctggacaagagacttctttcaagcaaactgaacattgattaagctcaaaaagttagtatttaaataaacaaaggcaatggtaaaaatattttgtctgtattagaattccttgtagttatgcaaggatgaagcccgttatgccatgatacattttttattcacaaataatgaaggcatgaatgagtattacttatggaacatttctgcagtttctagactccttctaaaatgtaagaatatgggctttatgcatatttggtgcaaaatatttgttggatcatgtaatatttttaaaagtgaataatttataaaatcatagagggtcttctgatttttattatcatttaatatttaattctacaaaacagaattaaatactttgttttgaaaatagtttattaaacacagttgcatttcttcatctttctaggcctcatcttcaagattatgtgggattttattaactgatttttctaagcctctggcttctttcttcctcactgtaagtgaaccacaggctatattacacacatatattttgttaaaatacatgttacttccattgcttcctggaccaccacaaaagagagcccttagtgatccaagtcaattcacccatatttaaaaccttttacatttcaaaaacatgtattataacatgattagatctgtactttacaaataagccagaaagtgacatatgtggcttaattaccaaccccaaataattagtgttggagcaagaaaatgaattaaatggaacacagcccagtcatcctagcaaaagggattacagataggagctggaataactttgggagaagccaaacatatataagaaggttaatgaattaaaaagttgttataggtaattcaaaagaaaaagaaaaatgctgactactaccaaaaaattccacagcatattactgaaactgccacatcaaatactttaacatacccctccctagggacggatagaagtttgcttggtatagtgtattttctagcataacattgtgataaaaggatctgaaaataaaaagaaatgaattgtatttttttccaaaagctatacaatgaattcaccttttcacagaggatagagatcatgaagaaaagtgaaattcatatggaccccaaacctctcattttggcccatagtttctgcctccttccccatcagaatctccaccagagcactaacaggtagcaaaattggctgatagaagcatcattctcctattccttccctgcccaccctctggtaaaagaattaatgagcagtaaaattaccaaaagtgaggcagcagaatggagaataaagaataccaagggtatggataacctacaaaccagataatgagctcctgaataatcaagacttgacttaaacctcaaacctctaaccttctggcttagacccatcattctatacttatatttagtgtcttaaacacagaactgccacagaattgcagtttgtctctaagtccttgtttataggaaatggggggcaagaagtgatgtctaaactttggcactttgaacactgttagtagcctctcttgacactccattatttccctcgtcttgggcacccaaagatgttattaacctttgtaggagtcctgaacattataagaggtagttgacaattgcactagtatctcttcttccctctcaatgcagataccagccttcagctgttccatcacattcacctaaaaggcttctctttggtttttctttaaaactttcttccttctcttccttcccattacttaatgtagtggggccactgcacaaaaatactctttgtcccctaccactaaaaaggtgatcctacttttagaattcacgtcaatttttcacaagcttcctgttataactattttatccagatccagatacatttctcaactcaattttctgaatcctggtatcttccttggtgcataagccattaatatctcaattcgcagagatctcacacttcctggtaaaactttgcccattccacttaactatggtctgaatgcttgtgttccctgttacccaaaattcataggttgaaacctaatccccaagggtgatgttagtaagacatggggtgtttgaggggtgattaggttgacatcccacatgaatgggattagtgtccttatgaaaggggcctgagggagtttgtcccttccaccatatgaggacacatacaaggtaccatacatgaggcagaaagccctcaccagatgccagatctgctggcactttcatcttggacttctcagcttctaaactgtatgcaataaatttctgtttataaactactcagtattttgttatagcagcccgaacagactaaaacaccatcacagtgatggtttcaaggcagcttttggacttcaaaactgcttttccatattttcagaaatgttctttcaacaaataatgccaagaataaaggaaaaagggttaccaagtccggaagaacatttaagctgaatgtcgtggaacggcagggaataacagtccaggattcttaaattagagaaataaattcctagggaaaatgtctgagacagtatcagtaacaaagtattccttgtgaccatgccacactggctgcccattctacgctctgcctgtgttcctttttgttttaaaaattgctttcgagccatgtgtaagtacagtttctttttcctaagctaatggcatcttgtctgctcaacactcaccctcacccctggcacaatcatgggtacacatgcacatttacacaccaccatatgtcatatccatagacactcaatacatgctgggacacattttacaatggtcctctcgctaccttgccctggtatcaactcgatctctttctatcacttattctcacttcattagaggcatggaactgaggcagacatagtgaatggagttactgtctcctttatttaggaaaaaatgtcaatgtcagaagcaaagtttgactctgtgatggcaatgattgttcctgctcgcagctgaagaggatgagaggaaacccagattggaagtatttattcccaaggctttactataaggaaacaagtaattttatcagaaacaagtaatccataatttgctgtacctcaactgcagtggtatgctcaactagtagagttcacatagaaatacttggatctgtttgcaggagattgcttctaccagactgggcaaggtgtggtctcagagtgcattatcatttaaacaaaggatgctatgaatcacagatgacagaaccagaaaaacgcttgctctagtgtacaaagtttggctgatacttaacctttgctaggggaaaaggaaaaaattgcaggctgctacaccggcagcctagaacacctttttaactacattcaagccttttactgttacagaacattattactgttaatactgccatgtgtgactgagaatttgtaccactgacttactgaaaaagcatcttctacttaacaaattcaaataaatttaattctatgtactagcagaagtaattaaaagcaaatgaataaggactgcataactgcataaatatttccataaattcttgcacaaaagaaggataatgagtggacaatagaatgctaaaatattaacaatgcatcataagaatttaaaaaaaaatttttttccaaatcagcaagatgtactaaaatgtaacttttatcattattagagcttaagttctccttctagaattaccactgactcactaagggctttgtgctaatcattcaatcagatttcacattcatgatatttattctgaaacagcctaatggggctcaaggactaaaataacctcattaattagattccctcacatggagtccaagatgaaaactatcaacaccaaatagcactctacagttacaaagatgtttcatatcatttcatatttacaaaggtatttcatatcatttcatgtttaatttttataactctgggggttaaagtaggtattattattactttcttaaaaaatgagaaaactgaggtttaaaaaggttaattggcctgatagagttcattaagtgttaaactggtctcaggactccaattttagtgttctagcacatagtacagtgcctaacacatatgggtattcaattagcatttgttgaattgagtgaatgaatatagcatgctacttctcctaactacacttgacctaattttactcatttgcaaacagccctatagttgcattccaaagtagttgataaggtcatttactttccaataaggaagcaaaatgccactgtgaaaataaatttagccatctattttggtgacataaggcccatgagctgaaagaataagatattcaatgtccagctgttataaagtttggaaaaaagttggtaaaaatattcgtatggttgctttaaaatgatgaactgattatcactattattttgttggggagggacctttcagtaaggttgcatggaaaagcagattaaaattgggaaaggcatttgagttcccaacatgaaaatcaacaatgcctcttgttatgcctttcattcacagacagagaaaaagaagtttcagagttggcagggaccttggcagtcacctagtctaactgctgtctcttcctcccctccactgctgccattttactagaagtcacagctaattaatggcagatccagcactagaccccagtcttcttactggcaggactcctcatggaagcagttggggacttatattctctctataggtgccatctaaaattattcattttagtctaaagtccttccttaaccaaggtgagtaccatatagccctgcttgaaaatataggattcccttacagtacagcttaagtggcaataggttgtgttatggttaaatgcttctctggccttttcaaacaaccagaatagtagactaagaagggctctggagtcaaactgtctagcatgacaatcctgccctgccacttactgactgtgcagctttggaagaaaattaactcctcgaacattgatttctttgtccgtaaatgaggatattatctacttcacagagctttgtggaacttatatgaaacaattcaagcaaagcatagtcaacagataacctgatacatagcaaaaatactcagtaaaaatgagttgacttttactcattcttccttacttgtagttgccctagatacctgagcttaaactgatcaaataaaccttggatgactttccttttattcaattaacatttattgagcaattactacatgctaggttcttgaaatacagcagtgaacaaaacagacaaaaatccaggccttcatggagctcacattctagtagcagacacagaaaataaacaaaataaataggtaaaatatatagtatgttggtgattaagtgctttgtccaaatacaggaagtacattaggtatgttagcaaaagctgtgacctcattttctaggaaacatttggtgtctcttaccttcctcacctgtttttttttagagctaagacaacaaaaactaagacttctttacatagccccttctaatcttgggatataaaggtaaatggcataaaatatggataggtgagttgtgtatgtgaatgggttagaaggtattactggtaattgaattattcagaaagcaagttccaatatttagccataaaactggaattaaaaatgtgtacaaaaataccaccaattaggttaaaaggagggcatatgcagcgttggaaagaaatttcaaaatctgtaacatctgtaaagctggcagagattgttactgattgtagcaggaaggggtagatcccaaactctggcaaacgtgatttgggtgggatagcaaatagcctagcaagactaaaaaatcgttttgagaataaccctatatcataaggacctctccttaatttatgttctccaagcactttcagtctctatcatcttattgagctatgaaatgtatagatgttcatttcgtatattgtctctcacttcacagaactagagagactaaactactaattttatatctttcttagtatatcatagaatgcacatttatggtaggctactaattgaccttgtatgtgatataaagaccaatacatttttagttatttttaattacaaagtctggtcaatattttcttcaagatcctctggcctggaagtgagtttctgttatgttcctattgagcaacaagaaatagtgacaaaggtgacaaatgcaacaaatgacaatgttcatgagagttttattaagtttattaacagagacatactgctttacttacctgaagatatcagaaaattacaatttgtttcatctttgttggtagctgcactagctgttccattacagaggaggagttgatttatgtgcagctgttgaaaacacaatgaaccagtcaccacaattttaacaagtgttaatgctggcatatccacttcagatagcatttataacactgtcatgaagaaagtttacagtatactacctaaagtaatgatgctagttccacatttgccaaatttggtgtcactactatagtactggattctactgggatgacaataaaaattcactctttcatggtcctttaaacaaggccaaagcatatgtccaagatcgatgtttttttattctccccaaagtaagctttataacacttggactgggaaaaaacaaagtttgttttattatccacaattaagtccctccttagatttgtctccctcttctcattctttatgtattaaaattgtgagtagaacaatttagtcatagttacaattaggaaaggggtacatttttactacaagttaaagttaagtcttcacccccaagaaagttacaaaatgtgtgtcgtgtgtgtgtgtgtgtatgtgtgcatgtgcgtgtgtgtatctgcagaaaagaggtagacaaggagcaataatacaatgtgatacatacttaaaaagcaccaaaaaatggagcgagatgattgaaagtggaaagacctgagctaaatggtggactagagcttcttgcactcctctccccacagaaacatcaatttgaacaactacctacacacaaaaatacctacccaagagtgaaggaaaccaggtgagagatgacagcactttggtggagctcagaaataagaaatgatacacggaagagtgtaagacagacagttttatactacccacgtcaatccctctcccaaccccatgcagcacagtatggaaagataccctctgcttggtagaagaggagggaagtgagcaccagacgttaccttggaccccaacaccaggctgcctcagtaaatcccactgctgggcaggctcccatggacccagactttaggctggtactcacagactgaacctctaagcccaccatggcatcaggatagctcccacagactcaatatccagccacgacatgtagactcagtctccaggtccaccgcagggctaggccagcctcagtagccccagacttcagactgcccccagcaccaggctggccatgatggccctaggcttcaggcccaccatagcaccaggtcagcccccacagtcctattcatcaggccaacactcctggatatagcctctaggactgcccagtgccaggccagctcctgaagcctcagactccaggcctattccaggcttcagactaacccacagctaagtaggcccatgtagtcttaggtttcatgcctgccccaatgtcaggtcagcaccctgacctcaggcactaggctagaccccatgaacataggtttcaggcctgcccagtgccaggccaagtccctgtgggcccaccatccaggcctgtccctgtggcccactgcttcttcagcaaacccatggtccaggcctgccccaacagacgaagggtccaggcctatcccagtagacccaagcactgggccagccctgacagacccaggcgtcaggccagccccacagtcccacgttgcaaaccatctccactagctccaggaaccaggctggcccctgcacacctaagctctatgactgccccagcatcagactagcctcaggttcaaggctagtctctgttacccaaggcttcagcggccttagggaccaggcctgcttcagaaaacccagggtactgcccaccccagtagaccctggttccaggacagcccccaatggaccaaggctctagaatcacccctgcagactcaggctctaggccagtccctgtgaattcaggctatctgcctacatgagtggtcgcaggtactaggctcaccacagtgccagaccagccctcaaggactcaggcttcaggctcatcccagtggacccagatgccaggcccatcccagcatctggctagcccctgcagactcaggtgcaaggcccagcccagcaccaagccagcccctgggactcaggctttaggccagcctccaaggatacagtttccagtcctaccctaatggacttaggctccaggtttattcaagtagactcaatcaacagatacgccacagtgaatccagactccaggctcaaccccaaccagccaggcactaggtccatccacctgctgacccaggcaccaggccagcctgctcaaagactccaagagcaagcctgcctgtggatcacaccaaatggtcttcccagaatctctaaatggactgactagtgaagggcttttggagacgaagccagtttacaaaactagaataagcccatacttttttaaatgtgcagataccaatccaaaaatatcaataatgatcaaggaaatacaatcccaccaaaagaacaaaataaagctccagtagccaactctaaagatataaagatttataatatgtctgacaaataagtcaaattgttttaagaaagcttagcaaacttacaaaacatacagagaaacaattcattgaaataaaaaaacaataaatgaccaaaatgagaaactaaaacatttaacagagattgaaattattaaacaaacaaacaaacaaacaaattctggagctgaaaaatacaatgaattaaatgaaaaatgcaatacagagagtcaacagcaggcttgatcaggcaggagaatgtgtgaacttgaaggcaggttatttgaaaatatacagtaagaggaaaaaaaagaatgaaaataaaggatgcgagctcacaggatttatggggtagcatcaatagagcaaacattagttatagaaattaaagtagaagagaaagatgacaaaggggtataaagcttattgcttaaataaaatagtagaaaactttccaaatctgggaaaagatataaataaccaggtaaaagaagatcaaaagtctcaaatcagattcaatccaaaaaagactatactcagacatataatcaaactgtcaaaaagccaagacaaacagggcatcctgaaagcaataagagaaaagaggcaaatcacatataagggaaattcagtaaggctagcagtggatttctcagcagaaacgttacaggccaggagagagcagcataatatatttaaagagttaaagaaaaaagaaacctagcaactaagaataaactttacacagcaaagctgtccttcaaaaatgagattcaaagcataccactaaaggaaatcacttcatcacaaaagaagatggcaagagaggaagaaaggaataacggatctgcaaaacaaccagaagacaatgaacaaaatggcagtagttaattcttacttatcaataattaccatgaatgtaaatgaaagaaatgaacaagaaacaaataaatggaaagatatcccatgtttgtggattaaaataattaacattcttaaaatgttcatattaccaaggcaatctacagagtaaatgcaatccctatcaaaatttcacagacattttttacaaaaatcgaaaaatcaatcctgaaatttgtgcggaaccacaaaagaccccaaataaagcatcctgagcaaaaagaacaaagttaggggcagcacactacctgacttcaaaatgtactacaaagctatagtaactaaaagagcataggttgagtatccctaatctgaaattctgaaatctaaaacactccaaaatccaaaattttttgagcagtgacatgacgctaaaagaaaatgctcattggagtatttcagatttcagatttttgaattacgaacgcttaaccagtaggtataatgcaaatattccaaaatctgaaaaatccccaaatctgaaacacttctggtcccaagcattttagataagggatactcaacctacactggcataacaacagatacatataccaatggaacaaaatagagagcttagaaataaatccattcctttaaagtcaattgattttcaacaaacgtgccaagaacacgcaaggagaaaggacagtctcttcaataaatggtgctgggaaaaccgtatatgcacattcagaagaatgacattaaaccttatcttacacatatacaaaaatcaatgcaatatggattagggacttgaatgtaagacctaaagctataacatcactataagaaaatgaagaaagggggtggctggaaagatggctgaataggaacagctctggtctgcagctcccagcaagatcaatgcagaaggtgggtgatttcttcatttccaactgaggtatctggctcatctcactgggactggttagacagtgggcacagcccaagaaaggtgggctgaagcagggtggggcatcacctcacgcgggaagctcaaggggtcagggaaccccctcccctagccaagggaagccatgagggactgtgccataaaacggtgaattccgacccagatactatgcttttcccacggtcttcacaacccgcagacaaaaagattccctcaggtgcctataccaccagggcccaggatttcaagcataaaagtgggcggccgtttgggcagacaccgaactagctgcagttttgttttcataccccagtggcgcctggaacgccagcaagacagaaccgtttgctcccctggaaaggaggttgaagctagggagccaagtggtctagctcagtggatcccacccccatggagccaagctaagatccactggcttgaaattctcgctgctagcacagcagtctgaagttgaccttggatgctcgagcttggtggggagagggacatctgcaattactgagacttgagtaggtggtttccccctcacactgtaaacaaagccaccaggaggttcgaagggggtggagcccatggcagctcagcaaagccactgtagccaggctgcctctctagcttcctcctctctgggaaaggcatctctgaaagaaaggcagcagccccagtcaggggattatagataaaactcccatctccccgggacagagcacctgcaggaaggggcagctatgggcgcagcttcagcagacttaaatgttcctgcctgctggctctgaagacagcagcagatctcccagcacagctctcgagctctgctaagagacagactgcctcctcaagtgggtccctgacctccttgcctcctgactgggagatacctcccagcagtggtcgacagacacttcatacaggagagctccggctggcatctggtgggtgaccctctggggtgaagcttcaaaaggaaaaaagaggcagcaatctttgctgttctgtagcctctgctggtgatactcaggcaaaaagggtctcgagtggacctccagcaaactccagcagacctgcagcagaggttcctgactgttagaaggaaaactaacaaacagaaaggaatagcatcaacatcaacaaaaaggacctccacacagaaaccccatctgatggtcaccaacatcaaagatcaaaggtagataaatccacgaagatgaggaaaaaccagtgcaaaaagtctgaaaattccaaaaaccagaacgcctcttttccttcaaaggatcacaactccttgccagcagagaacaaaactggacagggaatgagtttgatgaattgacagaagtaggcttcagaaggtgggtaataacaaactcctccgagctaaaggagcatgttctaacccaatgcaaggaagctaagaaccttgaaaaaaaggtttgaggaattgctaactagaataaccagtttagagaagaacataaatgacctgatggagctgaaaaacacagcacgagaacttcgtgaagcatacacaagtatcaatagccgagtcgatcaagaggaagaaaggacatcagagatcaaagatcaacttaatgaaataaagcatgaagacagattagagaaaaaagaatgaaaaggaatgaataaagcttccaagaaatatgggactatgtgaaaaagaccaaacctatgtttgattggtgtacctgaaagtgacaggaacaatggaaccaagttgcaaaacactcttcaggatattatccaggagaacttctccaacctagcaagacaggccaacacttaaattcaggaaatacagagaacaccacaaagatactcctcgagaagagcaaccctaagacatataatcatcagattcaccaaggctgaaatgaaggaaaaaatgttaagggtagccagagagaaacgtcaggttacccaaaaagggaagcccatcagactaacagcagatctctgcagaagctctataagccagaagagagtgaggggcaatattcaacatttttaaacaaaagaattttcatcccagaatttcatatccatcgaaactaagcttcataagtgaaggagaaataaaatcctttaaagacaagcaaatactgagaggtttggtcaccaccaggcctgccttacaagagctcctgaaggaagcactaaatatgcaaaggaaaaacaggtaccagccactgcaaaaacatacctaatcgtaaagaccatcaacactatgaagacactgcatcaactaatgggcaaaataaccagctagcatcatcatgacaggatcaaattcacacataacaatattaaccttaaatataaatgggctaaatgtcccaattagcaaattgggactggcaaattggatagagtcaagacccatcggtgtgctgtaatcaggagacccatctcatgtgcaaagacacacacaggctcaaaataaagggatggaggaatatttaccaagcaaatggaaagcaaaacaaaaacaaacaaacaaacaaaaaaagcaggggttgcaatcctattctctgataaaacagactttaaaccaacaaagaccaaaaaagacaacgaagagcattacagtatggtaaagggatcaatgcaacaagaagagctaactatcctaaatatatatgcacccaattcaggagcacccagattcataaagcaagttcttagatacctacaaagagacttagactcccacacaataatagtgggagattttaacaccccactgtcaatattagagagatcaatgagacagaaaattaataaggatatccaggacttgaactcagctctggaccaagcagccctattagacatctacagaactctccagcccaaatcaacagaatatacattcttctcagcaccacatcatacttattctaaaactgaccacataattggaagtaaaacactcctcagcaaatgcaaaagaacagaaatcataacagtctctcagacaacaatgcaatcaaattagaactcaggataaagaaactcacacaaaaccgcacatttacatggaaactgaacaacctgctcctgaaagactactgggtaaataacgaaattaaggcagaaataaatacgttctttgacaccagtgagaacaaagacacaatgtactagaatctctgggacacagctaaagcagtgtttagagagaaatttagacactaaatacccacaggagaaagtgggaaagatgtagaatcgaaaccctaacatcacaattaaaagaactaaagcagcaagagcaaacaaattcaaaagctagcagaagacaagaaataactaagatcagagcagaactgaaggagatagagacacaaaaaaacccttcaaaaagaaaatcaatgaatccaggagctgattttttgaaaagattaacaaaatagatagactactatccaggctaataaagaagaaaggagaaaagaatcaaacagacacaataaaactgataaagcggagatcaccactgatcccacagaaatacaaactaccatcagagaatagtataaacacctctacgtaaataaattggaaaatctggaacaaatggataaattgctgaacacataaactctcccaagactaaaccaggaagaagtcaaatccctgaatagaccaataacaagttctgaaattgaggcagtaattaatagcctaccaaccaaaaaaagcccagaaccagatggattcacagccaaattctaccaaaggtacaaagaggagctggtaccattccttctgtaactattccaaacaacagaaagaaagggactcctccctaactcattttatgaggccagtatcatcctgataccaaaacctggcagagacacaacaaaaaaagaaaatttcaggccaatatccctgatgaacattgatgcaaaaatcctcaataaaatactgaccaaccgaatccagcagcacatcaaaaagcttacctaccacgatcaagttggcttcatccttgggatgcaaggctgattcaatacacgcaaatcaataaatgtaatccatcacataaacggaaccaatgacaaaaaccacgattatctcaatagatgcagaaaaggtcttccatgaaattcaacaccacttcatgccaaaaattatcaataaactaggtattgatggaacatatttcaaaatagtaagagctatttatgacaaaaccacagccaatatcatactgaatgggcagaagctggaagcattccctttgaaaactggcacaagacaaggatgccctctctcaccacttctattcaacatagtattggaagttctggccagggcaatcaggcaagagaaagaaataaagggtattcaaataggaagacaggaagtcaaattgtctctgtttgcagatgacatgattgtatatttagaaaaccccatcgtctcagcccaaaatctccttaagctgataagcaacttccgcaaggtctcaggatacaaaattaatgtgcaaaaatcacaagcattcctatacaccaattatagacagccaaatcatgagtgaactcccattcacaattgctacaaagagaataaaatacctaggaatacaacttacaagggactcttcaaggagaactacaaaccactgctcaagcaaataagagaggacataaagaaatggaaaaacatcccgtgctcatggataggaggaatcaatatcatgaaaatggccacactgcccaaagtaatttacagatttaatattatccccatcaagctaccattgactttctgcatggaattagaaaaaactacttaaaatttcatatggaacaaaaaagagcccatatagccaagacaatcctaagcaaaaagaacaaagctggaggcatcacgctacctgacttcaaactatactacaaggctacggtaaccaaaacagcatggtactggtaccaaaacagatatacagaccaatggaacagaacagagacctcagaaataatgccacatatctacaaccatctgattgttgacaaacctgacaaaaacaagcaatggggaaaggattccctatttaataaatggtattggaaaaactggctagccatatgcagaaaaccgaaactggactccttccttacacctaatacaaaaattaactcaagatggattaaagacttaaacgtaagacctaaaaccataaaaaccctagaagaaaacctaggcaataccattcatgactaaaacactaaaaacaatggcaacaaaagccaaaattgacaaatgagatctgattaaactaaagagcttctgcatagcaaaagaaactaccatcagagtgaacaggcaacctacagaatgggagaaaaattttgcaatctatccatctgacaaagggctaatatccagaatctacaaggaacttaaacaaatttacaagaatgaaaacaaacaactccatcaaaaagtgggcaaaggatatgaacaggcacttctcaaaagaagacatttatgtggccaacaaacatatgaaaaaaagctcatcatcaccagtcattagagaaatgcaaatcaaaaccacaatgagataccatttcacaccagttagaatggcgatcattaaaaagtcaggaaacgaaagatgctggggaggatgtggagaaacaggaacgctttcacactgctggtgagtatgtaaattagttcacctattgtggaagacagtgtggcaattcctcgaggacccaggaccagaaataccatttgacccggcaatctcattactgggtatatacccaaaggattataaatcattctaatataaaacacacgcacacgtatgtttattgcagcactattgacaatagcaaagacttggaaccaatccaaatgcccatcaatgatagactggataaagaaaatgtggcaaataaatatcatggaatactatgcagccataaaaaaggatgagttcatgtcttttgcagggacatggatgaagctggaaagcatccttctccgcaaactaacacaggaacagaaaaccaaacactgcatgttctcactcataagtgggagttgaacaatgagaacacatggacacagggaggggaacatcacacactggggcctgtcagcgggtgggagggtagaggaggagaaatacctaatgcagatgacaggttgatgggtgcagcaaaccaccatggcacgtgtatacctatataacaaacctgcatgttctgcacatgtatcccagaacttaaagtataattaaaaaagaaaaacaaaacaaagaaaaaaggcaccatgacattggtctgggcaatgattttagggataggaccccaaaagcacacaacaaaaacaaaaatagacaaataggatacacatcaatctaaaaagcttctgcatagcaaaggaaacaatagactgaagggacaacctacagaatgggagaaaacattcgcaaaccatttatctgataaggaattactatccaaaatatgtaaggaattcaattcaatagcaggaaaataacccgattttaaaaatggacaaaggacctgaatagacatttctcaaaagaagacattctgatagccaacaggtatgtgaaaagatgctcaatgttactaattatcagggaaatgcagataaaaccacaatgagttatcaccccacacctgacagaatggctattatcaaaaagatgaaagataacatgtgttagtgagaatctggagaaaagggagtgcttgcacattgttggtggtaatataaattagtatagccattatggaaaagagtatggaggttcctcataaaattaaaaatagaactaccatatgacctagcaatcccacttttaggtgtccatccaaaggaaataaattcagtatgtccaaacaggtatctacacttccatgttcattgcagcactattcattatagccaagatgtggaatcaacctaagtttccatcaacagatgaataaagaaaataaggaaaatatatacaaaagaattctattcagcatttaaaaggaaagaaatcttgtcatttgccaacgacatggatgaaagtggagaacattacgttaagtgaaataagccaggcacagaaagacaaataccacatgatctcacttatatgtggaatctacaaaaattaaactcacagaagcagagtagaatggtggttaccaggaagtggttgggggatgaggagttgaggatattatggtcaaagggtgcaaaatttcagttagaaaggaggactaaattcaagagatctattgtaaaacatggtgactacagttaataataatgtattcttgaaaatcactaagagagtacattttaagtgttctcaccacaaaatatgttaagtatgtgatgtaacacatatgttaattagctcaatttagttattccacaatttatgcatatttcaaaacatcatgtcattaaatatatacaacttttatttgttaattaaaaataaaattttttttaaaaaagaaaagaaatgactaattctctggggaggggtgacctcttcagtaagttatgtttgagctcattcttaaagaataactgggtatatacccaaatgactataaatcatgctgctataaagacacatgcacacgtatgtttactgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacaaggacacaggaaggggaatatcacactctggggacggtggtggggtcgggggaggggggagggatagcagtgggagatatacctaatgctagatgacgagttagtgggtgcagcacaccagcatggcacatgtatacatatgtaactaacctgcacaatgtgcacatgtaccctaaaacttaaagtataataaaaaaaaaaattaaaaaaaaaataaataaataaaaataaataaataaattaaaaaaaaaaaaaaaaaaaaaaaaaaagaataagtagggcaggccaggcgcagtggctactgcaggtaatcccagcactttgggaggccgaggcaggtggatcacttaagtccaggggtttgaggccagcctgggcaaaatggcaaaaccccgtttctacaaaaaacaaaaaaaattagacaggcttagtggcaagcatctgtagtcccagctactcaggcagctgaggcaggaggaattgcttgagctcaggaggcagaggttgcagtgagccgagatcgcaccactgcactccagcctgggtgacagagtgagactccgtctcaaaaaaaaaaaaaaaaaaaaaaaagagagagaataagtagaacacagaggagaggaagtgaaacgagagcagagcatttcaggccagacggactgctggagcaaaggcacaaagtgcacagaatgcaaaagtaaattcaaggaaaagttaatgttcctgtaaggcttgaatgtacagatggtccttgacatatgatggtttgacttatgatttttcaacttcacaatagtgcgaaagcaacatcgttcaatagaaatactacttcaaattttgaattttgatattttccgaggctagcaatatgtggtacaatactttcttgacatgccaggcagcagcaaaaagccattctgtttttcactttcaatacagtgttcaataaattgcataagatattcaataatttgtagggacatggatgaagctggaaaccatcattctcagcaaactatcccaaggacaaaaaaccaaacaccgcatgttctcactcctaggtgggaactgaacaatgagaacacatggacacaggaaggggaacatcacacactggggactgttgtggggtagggggagggggaagggatagcattaggagatatacctaatgctaaatgatgagttaatgggtgcagcacaccaacatggcacatgtatacatatgtaacaaacctgcacgttgtgcacatgtaccctaaaacttaaagtataataataataaaaaaagaaaaaaaaagatattcaatactttattataaaatgggttttgtgttaggtgattttgcccaactgtaggctaatataagtgttctgagcacatttaaagtagtaggctagactaagctgtgatgtttgctagattaggtatattaaatgcatttttaacttacaatattttcaacttataatgtgtttattgggatgtaaccccattgtaagtcaaggagcatctgtaatgtaaaagggtgctgacgggtagagtgaccatgcctatccttttattttactatgagacttggatgctaactgtcttctttcatagtttaatcagcatcacctggaagtctaacagaagaacacccacactaaactcctctaacaaaaccaggctactggcagatatatagaggggcagaaaatctgcaaaataaaagataatcaggaaaaataaatgggacaatgaaaagtatagaaatgatttttaaaggatgctcacctcaaacacacctgagagagtgttggtgagtggcagcagaccttaggggataggatggctgtttctgataaggattcgagccgagaataccagaagcacagtcttatatgaaaaaaatctaaaaaaatcttctagtagtggctttcactgcaaaatcagagctttcacatggaggcagcatgcaaaagacagccatttgccaatagagatcaaaagtcatgatacagatcatctttaaatgcaaagggcaataatttataagtcagatgctgctgatgtatgcatttgaccaagagtcacatatttgccagcccacatccacatattagaccttctgttctttattaaaataatatatttttctgactttttggaacacaggtcaccaactttggtgttacagaatggtcttggagcttcctctccaaatatacttcactatcctcactccctcttccctctctgatcttttacaacttatctttcttcttcattattttttcttctcttagcttatgtcttccgagagcatctatgggaattatctggggcactaccaatgacactcaagggttgaaagagactacagatgtgtacgaaaagccctccaagagatattagtagaattccttaaaaaatctgcatgatctggaattggaaaaattcttaatgaacatttgaaatcattagaatacatttaactcattatttctcatgccataaaactattagagctggagtggccttagagactataaaacaatttcttcactttatatttgggaaaaatgagaagagaggtgaaattatttatccaaggcaaatagctgttgataaaggaactgacagatttcttaggaaatggcttttttccaggttgaaagaaatataccgaattatttacctagcttcctttttattgcagaaaaaaacacaaataacatgatatctaccctcttaacaaaattttaaatgtacaatagagtattgctaactacctgtacattgttgtacagcagatgtctagatctttttcatcttccataactttagttagttttcttcaagggtctactgaagttacatttttagtgatagcaactctcgtacatttgcaggtaacttccaaagcttattttatgtgaagtcatatcaatataatctggtgtcttacttcaagttgcttcattttaatttaatgagaagtattccaggttgtgtgagaatgatactctcttttacacagttttatatttaaagaataggaccttgatatattttattccagtaaaattaaaagggcttgttcagcaaaggcagtaagtaaagttaaaagacaagctgcaggctgggaaaggatatttacaaagcatgagggattagtatccttcaaatcaataacaaaaagactaacaaccaaatagaataacgagcaaatgatatgaataggcaattctcagaaaaggaaacccacatggccaataaacacatggaaagctaataaacctcactaataaatgggaaaatgcacattaaaacacagtgagacattatttcatacctatgaaattgatgaaatatttaagactgacaatactgagggctggagatgtggaacccccatgaactatctgtggaagtataaagtggtacaacaactttggagaacaatttggcaatatctagtaaagttgaagatgcataccttccgcaacccagcaacaccactttaaggtgaaaaatatctcacacacatgcacaaaatgacatgaaaaaatgatgtgtataggaatgcttttcgtaatagtaaaaaatgagaagcaatctgagacatccatcaacaaggaaattgacaaatacattaagaaatagtcattcataaaatgaaatattctacagctgttaaaatgaatggatatgtatagtaatatagataaatctcaaaaatatagagtgaaaaaagcaagttactttatgatacatacagtattatacaaattttacaaacatttaaactatgccaaatactgttcctaaattcatacatgtgtacaaacacatggctggtaaagggccacaccaacttcgggggggtacttcctctgggtatgaagggagggaaatttcattagggaagggcacaaagtaaacttcaactggtatatggtatatctgtattcttaagtggctggaaacaaatacagaaaatattaatgtttggtaaatctgtatggtgagtataactgtacggtagttctcccttaactgcagttttgctttccacagtttcagttatctgtggtcaagcacagtctggaaatattaaatggaaaattccagaaataaacaattcctaagttttaaattgtacaccattctgagtagcacaattgaatctcactcattctactccatttcatctgaggcatggatgatttacggcctcattcagagtagccatgctgtatacactacctacccattagtcacttagtagacctctcagttatcatgtcaatagattacaagaggaagaaggctgagtacaatgcataagatattatgagagagagaaaaagagagagagggaggaagaggaggaccatattaatataacttattacagtatattgttatagttgttctattttattattggttattgttgttaatctcttactgtacctaatttatatattaagctttatcataggtaggtataggaaaaaatatagcattatataaggttcagtaccatccatggttttaggtttccactgggaatctgggaacatattccctgcagaaaaaaaggactactgtataccatgttttctctatatttaaaatttttcataatacgatgttttatgaaagaatagagaagtgtgttttctttacaactatcaatagtcacattcaaaaactaaagttaaccatgtggtagacattatgtcaactctgaaccctgctttgtcagccatcaacttacacagtccaaacagacagagttgggctttggtgccctttttgtaaataaataaataaaagtcccacaaagagataagcatatgtaattacacattatagtcgttcaccatatgtattgtcaagtgcataccaggatcacatttaaaaccattcattttctgtgcctcagaagtgctagcatctgcagacattagatccatattcaagccagtgagatgagttaccatggccctctgttaattatacacaacattctctactttccttgtgaagagtgctgtgcttggcttgggtccagacatcaatttgtggggtaaagtgtttttaggtttaagaaaaaacaaggcagtggtttgttgctttgtaaatggtgtaggaaaatttttaaaagtgaacaagagataattcaaacatatacaactgaaagcttgttagtagctagagctcagtgaaggaagaaaatcctagaaagtctgggaaggaaatgacttcaactaattttagaaagtgatttatatggtcttaaaatggtttaaaaataaatggtcattattcaaatcacatagaccagtggtttctgagtctatgttaatatcaggaaattatactcacttattggggcttggatagataaaacagcctgtgtgttgatggacacaactctactaaatagagtaactaacccagccaaaatgcagaaacttgttaaaagcatctaaattcatggtcagtgcaaatacacaattatctgcagtcgggataaccaaaataaacaacactcagaaccataagaaggttctaaaaaacattcaagattgagaacttgacttttatgagttagaaaagtaatcaacgagcaaaagcagttcatgctaggccagggtttcatccattcagtgtattcagggacaaagccaacaattcacaaggtctgaaaagccatgcagtttctccaagtttaggcagaggcacagctacctgtaaatgggttgatatctaagtgtagatagatatacacaccaaattactgcacaactttgcagtgattctgccccctctgactggaatgctcttccccacttctctttgctaggttgcaattactcattctctaaaagcctcagcatgaacattacttctgtgggaagcatttctaccttttctaccctctacatctaaggttctgctaggtactctactatgctctgacaatcccccattacagtacttaaactttttaaagagtctgttgtcttccttatttggccataagctcatgagccaagagtcattcctgtcttgattattatatttttcccccagcatattacagtatctggcatatagtagaacttaataaatatctgttgactatattaatgaataaataaatagatacatagccagataaaagtatattaatgtccatccaattctacacagttcaaagtaaccattttttaaaagccaatgaggaaaaaaagtatgtttgaaaacatgaggatttatgtgtgcatgtctctttaagtttgatgatgatggtgaagtgtgcatgtgtttatgggtaagggaggggctttctaaatacacaaatactggtatacataaataattcctgaagagtcataattcctcggatttatgtatttatgctcaaactgtttccatccatgtttcatttattcttacaacctccaagcaaaagagataaggacagatattatcattgtcatttttccgaagaggaaatggattgagaagtgatgtgaacctgctcaactgcaaatggtatcccaatatccgagttgatgctccagccactagaacggtgtaacctggtaagatcacaattattaccacaatctttttagagcaagaaaaatagatatgagcaaatatctgaggcagaaagcaagcccataattcatactaactaatctgctttgtggtctctagtaaaggtaatttagcttctgggttcaaattacttaactagcacatacaaggggaaattaggggtacaatacaagtttactttccgttttcagttgataaaactttgcattaatattagtcagtcagcttaacagaagaaattaacaggctaataagatgaaatacatttaacaagaaagactaagattttagctaggataattaaatctaatatttttcttaaatgaaattgataggaaaacaaaaacttctggtctaatttatgtttgtaattaataccatacggaaagtaacattgggattaaaacatctatattcattgagctcttttttagccctatatgatccattttgattgttacacaaaatcatttaaatgaggggctctcccccatatttcctttctgtaaaataaaataataatcaatacaactcagtaggaagttttcaaatccaggaagcaaaataggtgctgctcccaaaggagttctgagggtcagttataaatgaaattatattacatttttcagcctcatatgatgccttttcatcaaggagctcaaagatttcccaggaatggccaacgtcctgggatcagtagaattaagccgtgaatggcgtctttgtctagaagtgaaaggcaatggtgaccttcctagactgagaactgagtagatcagccttatgattgtctctggttctattaacccactatcactggcatggcattcaactcaaaaggaagatttcactgttaaaagtaatctatgtgtttttagtgtttattgtaacatataacaaatgtgcacttctttatttagcccttctagcctcaccccatcttcaatgtactggctgatcctgctcctactttcagatctttctctctgatgggctacttgttgctcttcggtgctccatgagaataagaagcaataagaacaaaagtcacctattcctcaatagctggcataagaagtcatatattagggcaggatactataacagcaataactgctgttattaaatgcccattacatgccaagccctatatggtcaggtattttacatgcactatctcatttaattttatccacaaactatcagataaatattactgcttacttattttgtagaaggggaatttgaatatcaactggctaatttatttaccctaggtctcacagctaagtaaatggcagactcaggattcaaaccaaggttcgtctggttccaaaatacattttctatgccacactatcaccctgaagcaaaatgaggtgctctaaatagggtgttaggggtatgcatgcctgtaagcataaggaattccaaactttcagacattttctggcccaagaaatgatacagaactttgggtaacaataatggctaacattttttgagggtacagtacatgccagaaactgttctaggagctttacacacattgactcattcaatccttacaataaccctcttaaggtatatgctactatgacgcccatggcaatgatgaagcaactctggcattaaaaggtgaaatgacttactcaagattgcacagcttagaactggtggagctagaattcaaatttcagcagtctggcttcagagtctacatatttaacaaaaacattttattaatgagaaattggttgagatcaagaattgtcacaagaggaaaaagaaaataatcacagagttttagagttaagaagaaccttaaagattatttagtccaatcttcttatgttcctaatgagaaaagagaggcagagcaatattaagcaacttgcctaaggtcacatggcttgtaattagctgagcttgcatcacagcccaggccttctgacccctagtcatgtgctcattctattatatcatattatattctccctgatgcactcatgtaacaaaatgtgagttgaattcaattaaattgcctttctggacctgcacctgagctactaaacttgaatggggaaaaatgcacatagctgagcaaatgggcttcacgttcatttaaagcattcatgatcacaagcctcaactgagcactcatctctgctcaacaatgctacttctgtattaaacttgctttcccactctttaaagtgacaatatcttcattgttatcttcaatcctcctatattttcccccactccactccacttcctgccattaactaatgatatgcctcatacttcatggagaagaaaaaggtatcagaagaagtagctctttcatcttcctaccaccaaatctgcaaacctgtctatgtctctatctatattctgtgttgttaaaatggaacaagtgtcgctaaatcccatcctttcttgctgcttagactgcagatgttcctctttcttcttctgcatcatcatttctgtctttctactggaagttggccttggctcctactctttcaacattccatatattccaaccatcggttaaatcttatcttttgattataattctaaaatacatcttgaatctgtacatttttcatcaccattgctaacatcatccaagtcaccatgttctcttatctaggctcctgcagtaagtaaatagcctcctaactggctgtgtcatgcttccactcttgcccatctttaactcattctctgctgagcagctatctctagtacattttctgttgctataccagaataacacaaactgggtaatttataaagaaaagaagtttatttggcctatggttctgaaggctgggaagaccaatattaaggggctacatctggcaagggccttcatgctacatcataacacggctgaagggcagaagggcaagcaagcacacaaaacagagggaatgggggccaaacttctatctttttatcagaagtccactcctgcaataactaatccagtcctgtggcactaactcattcatgaggacagagccctcatgacctaatcatctcttacgggtaccatttcccaatactgttaacattggcaatgacctaatcatctcttacaggtcccatctcccaatactgttaacattggcaattaaattttaacatgagttttggaggagacattcaaaccacggttgcagtcaaagtagtcttttaaaaagtgtaaaacaattcattatcactcctgtgcttaaaatctttctatggattctcactgctcttagaataaaaatccaaacttgtttggacctataagcccagtatgatgtttacctctcccaacttcatctcatgctacattccctctcattcaactatactggccttccctgtgttcccgcaatacaaccactcatctcttgcctcagagacctgtgcttgctgttcctcaggctctttgcatgacaggtacttcctcaattatcaggtctcagcctaaaattcactttctcatagaaaccttttttccatgatatcaaagtaggtcctctcatatttttactcatccatagctatcttagcacttcctatagttgataagtattttatgcatatatttatgtatttccatgtttatttgtctgttgtaaagctcaatgagggcagcgacctttgtatatattttttcactgttgtttttacaatatctagcagagtatctagtaccaaaaaggtgctcaataaatttttgctgaactaaaaagttaattcctggattgctctgaataatatctgggacaatgctatttaataaggatactctaagtaggggaaaataattcttacttctttaggaaaagaatctggttgctttcatgatcccaaaccttttgccaacctttaatcagcaggttctaatctttttgtggtgatctctgtctgaattaaaaaaaaaaatctacaaaattaaaccagatgagggacaggaccctgaaggtgacagccgtttaatgctctctttgtcaaatatgctccgtctcactatacatgcttggacagaaagagagacacattttacttggttatttttttcctcaagccatttattcctctgctaagtagtttatcgattcttcaacatcaatttagagctggagcttacagcactcccatcagaaatcttacagtgctcaaaataaatgacttgcccaaagaataccatgtcagttgttaaagaagtaactctggaaacaaatacacctaaaggcagatactaaatatagatattcccttacacacacacacacacacacatacacacacacacacacacacacacacacaccccacttgggaactgacttttctaagaacaaaaagcaaaaataaaacagaaaaaaatctataacatatgaaaagttcagtagtatggcagtctaatacaaaaaatgttaaaattcactatagcctaccacctcccactgatgttccataatggttattttagacaggaagcacaaggttgccaaatgttcttgttctaaatttcctgtactagtttcacatcctacacatctagccctagtattaaaaatactgtccatgatattttacttcctggctttgagagcaggggtctcctaggcctgtctataaacctttagggactcaaattccaactttcatcctgtagaaagcatatctgccttcacacaccacccccttttagcaaaatgttggttatgctcaaatgctttgggattaggtgtgaggaaatcttgaattacatacctaaatataactccctaactggtgggccagataaacataagaaagacacatatgttttaataacgtcatctgaagtataagtattcatgtataatcacacacacacacacacacacacacacacacacacacacacacaaacagcactgaattttcttttcaccctagaatgaaagcaggtactaaactttcttgagtcttagcattgcacatttaaaataactgctttacatgttgatttggagttgcaactcatctgagatacggaggggattttccaaagtgcactggaatctgggcacacatgaaattgcaattactttccattccttttcttcaatttccccataattgctcttcctgatatatctctatcttctttgggggactatggaaaggggaccaacaaaacaggtagtctttcaaactgtgagaccagacagggtcgtttcattcaataaatatttattgagtacttgctaggtgccaggcactgttctaggagctggcatgacgagcccacacagaggttacacaggttcaaattagcttaagagagtaacaaggggggaagaatttctgatgtgtgaggctgtttttttgaatcaagcaatggaacagcaactgccataggctgtcagtagcaggtgaaatgtcaaatagggagtcttgtctttggggatgcctgactttagcttcccttctaatgccagcatagtacatctaaggattcagggaaaggatatccgaaaaatgaaggcgattttgctgccaactaagatgaatggaacactttctaaaggcagccctcaaaccattcttgccctgagccaggtttccactgttactttgatttacatcttgggtttaaggtccttctttaccttttactcctcatcactccaaagcagcaattagaggcagttcagggaaacaaattaactttattttataggaggaaacctcatagtaaacttctatcattcactaattcaacaaatgttcactgagcacctactatggccagaaattgctcttggtgctggagatatatatattagtatcagtaaacaaacagacaataagccctcatctcatggagcttacattttaaatgggggttgctaagttacaggcaattttgtaataaccacattacttagtactagtttaagtgataaaacaatcccttcttgttcctccattctctaacttccactatagagcccaacctttcagcccatgtcttcttgttgcttttgaagtttctatactactcctagacataacctttatattctctttcaactgactctgcctcctctcaggtactcaggcacatcccctttagttgggattagccctaatgaatggcactctccttacaatggaactccatctctttcagatcctgttgacagcaatttgactgaaatccccagggcactgggctccggtttctggtcttgggcatttacaaattcttgtttttcttaactgctctttaacctttacttcctgcttactttgttcctcttttttttcccctgataaacatttttcaaccatgttgagaaaggaggatagctgggaatataacaaagcaggatccaatttaaagaaatctatttgtcttttttttttttaatctcgattgtcaaagatgatttgaaaaagaaagcttctgggaccaggtaccgtgtcttcataaaactctgatctcatatatacattgttgcttcctgcagaatttctgcaagctgttctttaaaataattatgctgtgtgtttctgggttcttatgggattttaacattttgaaactgcaggggcaaacaggaaaatcttcaaatgtgattacttggtagtcaaataaaatgttataagaaatttctccatttttcacaccctccaatttttccaccccatctgaaatagaaaacaagttgaaaatacatcagtccaaagggtaattttatgaaaaagataagcacctaggaacagaggcttataatgaaagtgtctcctccaccatagagaaacactaatataattcaatatagtttataaaaccatccctgccaatcaaaatatagaaaagacaatttcctgtttgtggaaatagatgtgatactaaacagaaccaaatcaggctgcaattaacttagaaaaaaaacagatacactagactcagtctagctagaagaatgttgcattacaacacatttgcatgctagcttaataaaattaagatttccaagggaattctcatcctggggaggggaggcggtggggggtggaactgaatgagctatatagaaaaaagttaaatagtaaaaatagctatcattcacagagagtttactatgcacaaggcagtttacaaagtactttacatgcattttcttatttcattctcataattttaacaggtgagtgagtactcttattgtctcagttttacagatgaggcaactgaggctcagagattaagttagatgtatacattcacaccagtattaaggggtagaattcagatctatgtctgctcttaactgctaggttatgttgccaccaatagaatacataacatacatatctgtctatttaatatttatttacatgtaatatgtatgtatattatgataggtaaattctacacgaattagctaggcagaaagcagcataacatattagaaaaaaacacttgattaggagtcccgaggcctgggtttgtactctaggctctgacactaactagtttgtatggcttcaggtgagtaatttaacacctctgtgcctcagtttccccatctataaaacaagaatatcaagcagaagcttccataacatcccctttagctctaccattctattactctactgaaataagttatgtcacataaattaccatgaatgttttgcctttgcagataacttacaccgaaagcaactcaaggaataaattctgctaaaaagcacacccttgacacagcagatctgctagaaagagggagatgatttcaaaaggagaaacttcctgtgatagcaaatggagctgccagcgtagtctttgaactctccttcaccatcagccaacgaaagacttcagttattcttcactaaaaatgacagtctgcaagtattttggacctccaggtcgaggctaagttggcaagaactaaatggagagaaaaccattttacagggtcactgctaaatccagaatcacgggatttctgaagaaactgtatatgggtgactaaatcaaaggcttctgttaggtcaataaaaatgtttctaataataaaagtctcagactttgtttctgaaatatcactggtgctttaagttgaattgagagaaaggctagatatgaaacataactagaccactgttagagaattcccttctctagggactgagcatctgggaaaaatgtcacgtaaccttagcaagacacatggaatcacaatcaatgtaggcagactctgatttttgatcctttgtacaatgcacaataccaaattgatcagtgagtctccagaaaaaaaaaaatgagcacattcaaagactcgactggccttctacagggggttttcagcagtctgaggagcaactgattgaagagtcttaagcttttatgtttgtatttctccagagcagttcttggctagcttctctctgctctgctgccttcccaggtgactaacagctgttatctctgacccaggaagtagtgataagctacgttcctagctgcctttccaaagctctcaagagtgggtaaaagaggttactgatagtgtcttctcacttttactactgacagtgatggaattcctagagagctaatttttctcatgaaatattttattttataaaggtagccaaagaaaggcaaagaaaggctgggggagaggaagagagtaagctatttagctttatctgtgggttattttcctcatggcatagtactttgtgtttttaaattcaatgaaaccttttatcctctaggtgagcattttatatgaacccacagatggcttttttagttggccaatattagaaatacaaaggtgtctgaatgaatagataactgacattatcacagggttggaaagggaagaagcatatggcaggttgatactaggaattattaagataaaattgaaagtgttggaatttgaaagtgggtactaaattcatttggattacaaattattacaatgagaaaccagaaccttacagactaatcaattttcattaatggatttcttttgaccttgtccagtggtttctaaattggttcttgcaacagacccttggaatggcttctctccatttggtggcccagtgcattaacttatacttctcctgtgccaacagctcatctacagtaacagaagtgaagcctttctactatgagctctgagtacccaactaagtccacaaatggactagaaaggtcatagctgctcactaaccagtagacatgtcaaatcagatttgtataattttagagttgaaatggtcctttgaggttatcttacttttaaccttgatcccagtaaaagaatctcattcacagcatgcctaacagtggcatctagacatacttaaacatgttcaggactggaaaagtccttgcttcataagaacacccattccaccgccagacagtttgaatagaaaggttttcccctatatgctaggcgaaaatctgaattcctatggctacctgggttcatatccaggttccctcatttatatgatcttgggtagatcacttaatctctgtgtttcagtttctttatatgtaaaaatggagataacaatagtacctacctcataggattgcaattaaacaagttaacacaaatcaagtacttagcacagtccctggtacaaaataagtgctcagtaaatatcagctcttgatcttactgctaatattactgctacatttacaactgctactatcactactaaggataccctctggagtgacacatatcaatcttcaatcctcttgttcatatcagctcttcaaatatttgaagactcctatccaaagcatgagcttcaaaggtatgcatctctctgctttatattaactctgtattaggcaagttatctgataccttcaaatcagacactttgaaagcagataacacctactatcctggcatgatggctcatgcctgtaaccccagcactttgggaggctgaagtgggcggatcacttgaggtaaggagttatgagaccagcctggccaacatggtaaaaccccgtctctgctaaaaatacaaacattagccgggcatagtggtgcatgcctgtaatcccagctacttgggaggctgaggcaggagaatcgcttgatccaaggagacagaggttgcagtgagccgagatcgcgccactgcattccggcctgggggacaagagcgaaactctgtctcaaaaaacaaacaaaaaagaaaccaacaacaacaaaaaagaagataactcctactgtacagggtggctgtgagaataagaagagataatatacgcaaagtgcctggcacaaaagaggtacttaaaaatatgtcagttcccttccccttctccattcctaagttttttcttttctagacactaaaagcccaatatctaacctttctttacatggtagtgttttccagcccctggccatctttgtttcattctagtctgtcaagtatctttcttaagaagtagttcccagaatgatagaaagcatgattttaggtatggcccaagtatgccatgcagagtagactgttccttaatctcgagaagataaagctcaactcaaggcacatgtggtcaaggtaggggtcacatatagtctcttatcactatgatattttttgttcattgatttccttttttcctggcccataggctaatgagtgataaattccatcagaaattcaagttacttactgaatcagaggagttgcactggcctgctcctgtagctctttcctaggactctgctttcttagcagttgggatacatacacaatgcagtgaatctaattcctgccacacacactaaggggcattgccgccaaagtgtctcttgcaatccattttatgtggttgctttccaaggcaacttactgaattaaaaagataataaatttaatcttgttggttactactgattaagcatctcaagtcatgtaaagaggtagagttcatgctttggaagtgtaatattggagttcagttttcacctttctgattttctggaggcagtaaagaatactgagaagatcactaattgagtcaaggaacttgagatcaagccctatctatgccactaacctacctagtgtttgaacatggatcagtcatttaacctatttggatcacggtttcctcattcataaaatgagggtgttggactacttaagttttaatatctcttctgggtccaataatgtatagttctattctgtagccttatggttaaggtattatatcttcccacaccatacttaattgctttttaaatcaggttattgctgaggaatagcccgggaaaaatgggagttttaaacaacttttataattttaatagagaactgaaatagttgaatatttctcttcctaacctcttgcttaaataattttaaaacagttaattaaattatgctttacaaagattatcattatatatccaagctgaaggggaaagttcaacatttacaattgagttacaacagagggctgtattgagcaagaccatttataatgtattaactataagaaatggaacctgaactttagtagacaaccatactcctcacagctcaagacctagtaatatgttgtaaaaaagtctgagaactatattgcccatgactttggatcagcaatcatacaataaatatgtttaaaatttttgttattaatttaaatcttaatgtagtcatcaaaactactgtcaggtaatgcctttttgcctctagtgcatgtaaaactatcggtttatgagagaatttcaatgtatgggctgacatcttggataggctctactcttttttacaatcctctcagaaaacagtctatatttcatcctacctctgtctctccatttctataaaatggaggaatttttctctcaaaatcacagtaagcattaaataaggtgaaatgtattttaaatgccctataaattaaaaatatcctggtcatcttattatcttgtaactatttaacttatgttttaagtagcacagatttatagagagcatatcaccaatgaagtattactgtgcaagtgaattttagatgaagtacagatacattttttaagaaaaatatacagattatttacatttgagctataacaccattatgccttatgttcaaattattagaaaattataggccaaaaatactgttgaaattaaaatgcattctatatactctatggttaaacaactcacaaccaattaaatcaacgtgaagaaaccaataataattattaaaagctagagtaggagcaacaaaaagcaacaaccaactcaatgcacacttataatacaagattttctctcttttaaaaaataaataaataaataaataaataaataaataaataaataaaacagtctattaaaacccttggccgggcatggtggctcattcctgtaatcccagcactttgagagggcaaggcatgtggattccttgagtctaggggttcaagaccagcctgagcaatatggtgaaaacttgtctctaaaaaaaatacaaaaattagtcaggcttggcagtgcatgcctgtagtctcagctacttggaaagctgaggtagaaggattgcttgagcccaggaagttgaggctgtggtgagctgtaatcacaccactgcactctagcctgggtgacagtgcaagaccccatctcaaaaaacaaacaaacaacttcttactttgctcaatgagacctacagatacacagcccaactgaaatcttaagaatcaacactggttattcttattaataaaaactgttctataagacagtgatagaatctgtttcgttttggcttctaattggagaaacaccatactgagtcatgggccatgttctggattctgacagtggcatcactggattgttttagaggagaacacggtccttttcctctatgaatatgctcttgaatgttaagaatatttagtaaaacacacaaacacacacacacatttgcagggtgggagttactgtattattttgcagagtgtattgtatttgctatcatctacttctctaatggactaaaaaggtagcaaatatgaaaataagaaaaccacaaagaagccccatttttctacattctggcattcttcagttagattcagcagtggctaaaagataacacagtggaggagggggaaaccttggattaccacagcatcatttatactgatatttccaaaggtcataagaatttaggaccaggctcgcttcccacccttagttcactccaacatggccattgcttccatgatgacatgatttcccaataatcctttacagggctagagaggaataaacagcagaatttccaaaggcctatgttattactttgctttccccaggtgggatccttgttgctgtccctcaactgtgactgagagccactacacagcagatggttaagaaaagaggactaaagtttaaattaacaaccatcaccaaccaacattaagcctccctttgaaacaacaggaactgtgaaatctgagtctacatttctgttgaagggcaacaaagcagggccttctatgggagacagcatttactgtctttttaacataaatacatcaagctagaatacatcaagaagaagataatagtgcatcactaattcagtaattgtcacaggactctttccttctcctcaattaaacagttaacagggagctgggattcacacaaaaaaagaaattcgctcctcctcccctcttttccaatttgatttatgcatagcccctggagacacaaattaatgtcttcatagaccaaaagccccagctgttttgaaaaatctatgacaaagcttaactaaggttcacacatgcaaacataaagcccccataattactaagttgggtattacaaagctggctcctcaaccaagggtctaaagccagccgtaatgccgtgctcaccccagccaggctggccttaatacacctatagtgctaatttagtactgcctgaggcattgtggattctgggtagatagacactttaagcaaagctgaggaaaagatatagaactatagggacttaaaaccacaattcatcatttattaatatcagacagaagcactgaaaatatgcaagacttcatttcttatgtagctgattcctttggcttatttattctttttatgataagaaatcagaaaatgagatgattaattcaaagaaaataccaaaagaaactcttaatgccctatccatccttaaacgaaccaaaggcaccccactcagctactctacccccttggaagaatgtggcctgcatttgctcttccacttcctctcctctcatccactccttaatcaatgcattctgaattctgtccacagtattttacaacaaccctttcaaaggtcactgagactctttgttgctaaagccaatgatcacttttcagtccttatcttattcgttctctctgcagcactaaactctgctaattattcctactttcttgaaactctctcttcccttgccttctgtgataccccctaactcttgggtttatctttctcagttttttttcatgaacttctcctttacccatttcttaagtgccagtgttttctagcattccatctttatgcctcatttattctttctctaaaatcagggactcttaatctgtacatcatgagagttcatggatacacctcaagaggtctgtggaccttcctaaaattgtatgcagaatagcagaatagtgtacgtaaattttatgggggagagggtctatagttttcagatttctaaaggagttttaggcaaagtcaagtctaagggcaactaatcctcagattagctctaggtggccccgcaacttcaaatcatatcactatatatgctgataactttcaaatctatatttctaatccagatttttctcagtgtgggcatcccataaatacgtttactcaacaatcctgatcttcctctcgtgttctccaagtcagtaaatggctcacaccccacctagctgcccaagccagaaacctgggagttatccatattcttccctctctcccattctccatatccagtaaccgagccctacggactctacctcctatctcacatgtgaaccttctctcaataacaaacataataatctcagtccaggaagattattgcaataactgcctcacatgtcttcctgcctccaaccaactctctagttgcagacagagtaatccttccaaaagacaaatatgatcatgtcactcactgacctaaaaactttccggtgacttctttattgttcatagactgcagaacttcaaacttcctggcatggtaaataaggtcctttacgacttggttcctgcatatctctacagtctcgtccatactctattgctcaacaacccctttaacctcacccccaccctggcccaatccttgactactttataatctctagtcatacaaaactatttttcagttctagcctcagggatttcatacactttaacatcacatcagcctggaatacttgtaccaccttggcctgggcaacttctgccagaaagctatctctagccacctaaaagagagttagggggtacctcatatatgctccgatagcatcctacatgtgtaatcacatatccttctgtatgtgattctctatttctctgcttctctatttcccactagagtttgatgaataaactataagttccttgaggtcagggaccatttggtgtccgtggcacttagcacagtgtctggtacatcatagttggttaataaatatatgttgataaactgaatgaattaatgggaagaaaaaattttcagaattttgacccagtactgttaatccccacaatctttgccttcagcctggcataggaaacaaaacagtggactccagagaggtcagctgccttagacattaactctatgagcctcactttccacactgtacaactaagaaaaagttctgtataatctcttatggcttggcaattctgtaatttgctgcttccttaacatatctatttctcatctcccaaacctcacttagtccctccacccgcttccctactccccccttgcctgtcatccagatggcactgtgatgatctggttgaggcatttggagactggttgggtaaaggccactatattttgtgcatgtatcgtgttcatgagagagagaaagggaaagagaaagagaaggaggaagggagggaagaaagagagattgaggcaatcatctttcccttcccatttctatccttcgtaaagaatacagttggtcttagaggtccaatttcaaaatgttcatgatgttaaatcgttacacgataaaaaattcctaaaattgtttaagatcactcagaacagaaaaaaaagtaagataaaagttaaggataaccaagtagacacaaattatcttgaaaaagctgaatcgcagtaacttgacacagttttttggaataaggcttactaaacattgaaaaggaagggagatatgttatttgaaaggaaatacagcctgaacttccctggtcaagagaggtggaggaatcgtggctccagaagcatctgaagttactgcaaagctatggaaacatgtaacaataataaccagcactaagaatataataatgcaaggaccaattgtctgctggtccctgggggaggaaccagatggcataaaagaccaattctcatctcttaatttctttgattgataagaaggatacgcttccatttagttctcataaacagtgaccccttttctcctctgtggacaaagttgatgcactatcacttttgcttccagatattaaactcatatttaatgatatgtgtgcttggtaatgcatatgtccaaaaactttcactgacaaaaatggccctgcatgcatctatttgtctttcagttgctgcacacaaatgcagcagggaagtggggaatttaaatgcacagcaggcagccaatgtatttttccataaactagtctacatatcatggtaagagtagaagcaaagaaagcctcagatgcattctttcccataaagaggcaaatgaagccaaaggacagggtagtaagaaagaaaatcaaaggctaaaatgagattactagtacatacccttttaaaaacaaatcagaagaaccattatccttgccaacattgaagatgggttaagctctttcagtgcaaagaagagtgtattcttcctattgtaaacaaatccaatagttttgtttgtttgtttgttggtttgtttttcgagacagagtttcactcctgttgcccaggctggagtgcaatggcgtgatcttggctcaccgcaacctctgcctcctgggctcaagcaattctcctgcctcagcctcctgagtagctgggattacaggcatgtgccaccacacccggctaattttgtatttttagtagagacagggtttctccatgttggtcaggctggtctcgaactcccgaccttaggcaatctgcccaccttggcctcccaaagtgctgggattacaggcatgagccactgcacctggccaaccaatactatttttaacatggttagatagatgtcatttcacttcagaagtggttatgcttcggtaatggatagagttagtatatcatgtaaaaggttaagaagcaaaacaagaatatttaaaataagtagtaatgtacagaaaaaaagaaaactttcacaacgtgcattgtgcttgctggtcttgaatatcataaaactttgatagaaaaacacatatatttgtagggctcctatacaaattcctgctatatctcacttataaatacacaaatatatcattatattttcatatagtataacatatgatagccaggcagagatcaggggtcaggaaagctcacctgagtcactagactaatgaagtaggaagaaaccacaagagactacggaagatcaggttgagaaatcagggtctaacaaaggggtcagtctttgaaattaaaaactttatatgggaatacagactataggtgtgccctactttaagaaaatccactgtttccttatccaatccacaaaccagaaaagcaagagtgcttatgtgtattacagaagcactccatgtggcaatttttttttttttttttgagacgaagtttccttcttgttgcccaggctggagtgcaatggcatgatctcggctcaccgcaacctctgcctcccggattcaagcgattctcctgcctctgcctcctgagtagctgggattacaggcatgtgccaccacgcccgcctaattttgtatttttagtagagacggggtttttccatgttgatcaggctggtctcgaactcctgacctcaggtgatctgctcgcatcagcctcccaaagtgctgggattacaggcatgagccactgcgcccagccggcaatcttttacaatgctaagctaacattgtacatgcaagtaagatttgtttctacaaatatggaatttatatgttcagtttatcagaagcacattttcggtacaaagtgaggtatccatgtaccatcaaccttcatgtggacttgcttttgatttttcttttataaatctgaattttagcatactgtctccttaaaagttagaatgcctgtactgtgggaaataggcagagagaaaaaatccatacttcataagcagaaagctgaaactatgtccaaccagtccctattgaggaagtagagtttttcccacaaaagtgaatggggaaacattcttgaaacatcttaaagccctaaggccaaattcaggaggctgtaataaatgagaagtaggaagtccccagaaatctcctgaaaaggttgaattgtattatttatatttgtaacgaaatgtgttttcacgtttgtgttaaagatgaatctctggggtgagttcagcctgaggtaagcattgaggtctagtttaatggaggatgaagtgttttttttttttacactatatttaagcattggtcagatatacttaagacctatgaataaataaatataaataggattgctttaaggaactcctgagactgtctgtggttgtctattcatattaatatataagcataatttctagttgtgctactagtggcatccatctgtacattatatttctagaaaaatgttacaagtttgtaaaaatatattattctactgcatagagcacctagttattaatttcacttgtgattgatgttgccttgaatccaattataaaaaacaattaagctgctatattagcagagtggtatctattaggtgacctctaaggaaaaaaggccagatgacaaaggatccatagaaaaatcaggactaaaacctagacagttgtctattcttctgcctaacccagacacatatcataaagaagaatctatgtacatcaacagtataaaactttcactcagtaacagaacaaatttaaaccagctgttgtgaaactaatatctgcactcctacggtgaatgattaaagtcaataaatgtttgttgactgaccatgatacaaactattgttgtacattatataatgttcaatgattctattgtgttaaagataaaagtcactctaagtatgtaaatcctagttccagtattattctaggctaggagatcagctttcagtctaataacttcagacaagttttagttacagtctcatgaccacaaattatctaataaccccagtttcaaagctctctaaaaatagcctggtcatctactatctggaaaatgatgaaactggtcttggtttctccaaacctctagggtttttttgttgttgtttttgtttttgtttttgttttgagatggagtctcgctctgtcgcccaggctggagtgcagtggcgcgatctcggctcactgcacaaacccctaggttttaaaaataactgtacaataaatatgattacatatagttagaagatcttatgcatataaagagccatcgttcaatttatcaatgtcattaaataaagatgaacacctgaaaagattgaattacagattctcagtacataatgccaaaatctacaccacaataaatacactactcaagaaaaagtcatctatgagggaaaaaaaaagcagagagtaaaagaaaactgtgcaagtacccttaaatcaaatattgtaaatctagcatgaacttttaaaaagtggaggtcctatttttttaccaaatggagaatggatttctacctttgagttctaaactctctttgtaatacttttctctattaataaggtgctaataagacagaagtaaaatcaacccaaagcaaaaataaaccagaaaaacaaacaaaatctaattctatctggccacaaagccaattttctccctcccattgcactggcaacagcagtagcagcagtggctgatggcagcagacccttcctaaagcaatcttatatttgcaccagagagaacattctggccaaattggtcctagaagatgtgtctgcaagatgtaaaaaactgcaatcccagtgaaccaagattgtgccactgtactccagcctgggcgacagagtgagactgtcaaaaacaaaacaaagcaaaacaaaacaaacaaaaaaaaaccaaaaaaaaactgcaatcctaaatgatctctccttgaggaaagatgaaaatctttgtcagtaatattaggtaacctgggctggagaagatgtccaactgcaaaacagtgagtaggcaacaggtgaggaaaaggaaaaggaaaccaactaagcccaaagaaaccatagcaagaagctgaaagcactagttaaaatgaaactcgcatctgtagagaagcagtgagaaggataaatcaactaatggctcaattatacttttaaagccatcagtcaaacaaacaaaaaacccaactgaacttttaaaaccatttttagtacaacttatatttcacagttatttattttcttaatcttaacaataaacaactgttgttacataattaaagatacaaggtaaagggatttaagtggcagcttaagctagctagttaagttagttaagctgtaagttagaactacctatatatgttccagttttcacactcagtccatcccaaggactgtagtcagagactaaagacaagaaagatgtttgaagggatggtggggtggaggggagactatgagaatagaataaaaggattagagtgctttaatctggaaagataaacaatcaatcaagaataaccaccaccatacaaccatcaccattaagcacctactgtgtgacagtcactttgctaagtgccgagatattgaattatgtccaagaagagaagaagtgttgtcaaagtggattttaacattctttctttcagttatgctctctgtgtcaagcattgggctggtcatggaacagttgtgaagcaggaaacagcagaatgtcgtggaaagaaccccagattggaaattagaagatttaggttttagttctaagagcattattaactatatgtatgaccttgaacaaatcactcaacctttttaggcctatcttatgatagagatgttggacctgtcagcggattccaacttttttttagcagccaaccctttattcaaaagacaacttacaggaatatcctacacataaaagagctgaaagtagaaatcttatgcttgaagcacagggaaggtcataacaggctcataagccttctcctgggcctctccttctccctgaaccagtcttacatgcatctatacagatgccttcatggatcctgtgaacacagtttgaaaatctatgggctaaatcatctttaacaattccctctagatctaatatcctatgactgtgaaattttcctcacctacatcttcaatagcctttattcaattcagtccaacatgttgaatatctagaatcatagaaagcacatgacaggatttctaccatagaagagctcaccatctttttggggaaaacaaaataaataaaatgggaatgcacttgaggggaaggggggctttaagcagcaggacaccatcaagggcccattggaatagaaagtccacttctgtatcttttttatgagtgtatcatcagtgcctggggcaacagacattcaaataaacattgaataaataaataatgaatttatggatggatgggtgaagttattattaatcatgttcactgaaattcagcaaaaaggtataaagtactttccatattttatagaatttttttcttatatgtacagggttataagaaaagccatcaaatttctccattattcattctattatttactacccacaattacaaatggtgatattagaataaaaacaaagcaaaaaagtacacccattaagttagcatcctccttgaatcagcagaacaaataaaggcaaaattctactcaaccatatgaaataaaattttgtgggagcaaatcatcagactgaattttgctttgccaggaaatttttctttcaacgaacacgttttatatgtttacattcacatgctgcaagtaaggaagtctccaaagtaggtaaatcaagttaaaaacaaaggctattttctctgccccctattccactactagtgggaagagagcagggagatcaagaaggcagcagctgctttcctttttccccccaaacttaaattccatccaataagatatgttttgtctttttgcactcaaagtcagccagcaggcacttaagtgaaattaagaacaactgcaccaatggcagataatttgatggagagcttattggagacagctcatttgagtaaaagctttgcctgttcaagaaacaatataatttctgaaggaaatctttctggaaagggccaggtggctctgtaattttatggctcaggtgatatcagttatccaggacaagtgttgtacatgactaatattctcaaaccagaattgtatttccccagaaagctattacatttaaaaagacattaaggtgaacttaaattccatttttgttttagcctagccctaatttttattatgatatactatatactattccttttttgaatatgccttataaatggatatatattttttgggttcaagtgattctcctgcctcagcctcccaagtagctgggactacaggcagatgtcaccatgcctggctaatttttgtattttttgtagagatgaggtttcaccacgttgcccaggctgggataaatggatgtattttttttttcttttttttccttttttttttattatactttaagtaaatggatgtatttttataaaacagctttcttttttcaatctatggtgcctgatacctgagttgcttagagagatatcgaactaatagatgaaatgagaaacatcttatccctttctagtcttcctccaagatacaatgacatcttagggaaaaggtagcatccttttctctgttctaacaaatgtagacagcccagtcaatgtgtggctccacagatagctacaacaaaagtcatactgaggaggataatacggcagggttctgaccacacagtatgacatcactgctttcttctattcattttagctattcccctgtaaaatctggattcaattcaatgtcttcagtttcatttggaagatctacatttggaatcgatccagttagtccaggggccacatgaattttaatgcacctggggcagctggccaaactgtcatttgcttctatcatctaagcaaaatgtggaaatttctagtcaagacttttccaattttcaatttaccaccttctcatcagagggctacaactgctgttttcagaaagaccttgcccctatcctaggacaagaaatatgacttagatgagaaaaaaaagaagaagcaaagaaagaaaacagaagttattttcttcctttcacacattttggcctaagtttggtgtatatatctaatctaatgttattgtctagtagcatatgagttggttaaaattctttacactaagtacccagaattttctattctttcttctctcttccacccaaatctcttgtgacgtatttattcattcaattggccaaaatatttatttagagcctactatatgccaatgacttttctaggcaatgggaatacaaaagtgaacaaaacacagcccatgcacttatagagctctgacactttccaaggagagagacagtgaacaaatccatagatacaaaatagagaatcattagtcatatgaaaaataaaatatcacatagtgataagtgatataaagaaaataaagcagggcaaacatatccagaatggtcataaaggccattctgaagaggtgaaatttgagcatggctttaaatgaaatgaagacttgtcttgatttttctttgtattcaaaggaaacccaggaagaggtcactaaaattactgtgtcctgagttggaagtaaaaacagtcatggagttgagacatttgaaaaataccatcaagatattcaaggatgtcataatcaagctgaagatcatctactaacgtcaactaaatgattgaagggatgaaaaatggctgagaagggacataattgaaatataccatttcaatgaccattatgaacattatgtacgggagatcataataggacaactccctatttaaagtggtgaattacaacaaaaaaaatatatctgagtctctagtttcaagacaagacagcatagttgcacatctctctatttctcccattaagtacagctaaaaacttggacattatatataagacaaacataagaacattttcaaaggtggagaaaaaaagtagacttactagggactttgagacccagggaatgacaaagtggtgaattccctgggtattttttttttactatatatatcccagaccaggtattggtaaaaccagcaacctagaaatgccaatgggcagagggaaaaaaaaagcctcaagaaagccagcttttggccgggcgcggtggctcacgcctgtaatcccagcactttgggaggccgaggcgggcggatcacgaggtcaggagatgagaccaaggtgaaaccccgtctctactaaaaatacaaaaagttagccgggcgtagtggcgggcgcctgtagtcccagctactcgggaggctgaggcaggagaatggcgtgaacccgggaggcagaggttgcagtgagccgagatcgcgccactgcactccagcctgggtgacagagcgagactccgtctcaaaaaaaaaaaaaaaaaaaaaaagaaagaaagccagctttctctagtcaaaggaccaagaagggggagtacagcaagacagaaaacttaaacaatagccaaacaacacaagaaactgcacccctaacctcatccctatgagcaagcactgagtgaggaaaccggacttccaccttctccaggatctaatgaggtgtcccaaccaacctacgggggtggtgtatcaaagaaggccaagtagagagctgggtttttttaaatccccaatcagcaatgtcataggaatcaagtgctcctctctatcaaccagggtgatgtcagcaaaggcctaaaggggagcttcaacttccacttccaacaagcagtaatgaagttcccccacccccatttcctagagtttcaatggaggctgagtggagagtctgtatttctacttccacatggcagtaataaggtaatgaccacttcccctgccagcatgatgtcagaagaaaccaagtaaaacagaagatttaaataagatccagagtcttataatacccaaaatgtcaagaattaaataaaaatcacttatatcaaaaaccagggaaatatcaatttaacagaggacacaaacaccaagatgacacagacgttgaaattatctgacaagtattttaggccagctgttacaaaaatgctttaatgagcaactatgaacatacttaaatttaaaaatagaaagtttcagtaaaaataaaagatgtaaagaaaaaccaaatgaaaaaattaacactaaaaatacaataaacaaaaatttaaaaatcctggatggactcaatagtagaatacagacagatgacagaggaaagaatcagtggacttgaagatagaacaatagaaattacctaatatgaacaataaagagaaaatagagtgaaaaatagtaaacagagcctcaaggacgtgtagcacaataacaacagatctaacgtttgtatgactgaattctcagaacaagaggagaagaatgggtattcaaagaaataatgggtaaaaagttcagaaattttaccaaagacataaacctacagaatccaaaagctgaactaaccccaaataggacacacacacacaaatctgcaccaatgcaaataattaaactactgaaaactaaagacagtgaaaaaatattgagagcagcaagagagaaacaacacatttacctataagaaaaaaaaaattagaatgatagcagatatataagaataatcatacatcatgtccaattgaggcttattacagggatgcaaggctggatcaatattcaaaaaatcaatcaatggaattcaccacattagcagaataaagaaaaattgcattatattaattgatacagaaaggcatttaaaaattcagcagtgattcacaataaaatgtctcggaaaacttatgaatagagggggaacttcctcaacttggttaaaagcatctacaaaaaaaatctatagctaacatcttggtgaaagactgaatactctttcctattattggtaataaggcaaagacatatcctgtcaccattcttattcaatacagtactgggagttctagccagtgcactaagacaagaaaaggaaacaaaaggcatacaaattggaaaggaagaaataaagttcactctatttgcaggtgacatgagggtctatgtaaaaaatctcctagaactaatttggaattcagcaaggtgagaggctataattaataccaactacaaaaatcaattatatttctatatattagcaatgaatatgtggacaccgaaattaaaaataacataccatttacaattgttcaaaaaagagaaatatgtaggtataaatcttaggtacttaagtataaatcttcggtataaatacttaggtataaatctaacgaaatgtgtacataatttatatgttgaaaactacaataacgatgaaaaataaaagaagacatcaataaacggagacacatactgcactcaaggattggaagacagaacataggaaagatggcagttctccctcaaaatgacgtattggttaaatgcaatatccatcaaaatcccagcaagattttttttcagatagagacaagcttattctaaaatgtatatgctagacaagcttattctgaaatgtatgtgcctaatcaaagaaagaaaaatctttgggatctagggcttgctctagacatgacaccaaagtacaatccataaaagaaaaaaaacaatacattattattcatcaaagttttaaacttttgctctgtcagagactattaagtagatgaaaagacaagccacagattggcaaaaatatatttgtaaagcacatatctgaccaaaaaactcatatacctagattatataaaaagctctcagaactgaacagtaaaaatataaccaattagaaagaaaggtcaaaggacataaagagatatttcataaggatgatatacagatggcacataaacagatgaaaagatactcaacatcactagccctcagggaaatgcaaattaagatcacaatgagatatcacgctcacctatcacagtactaaagtaaaaacagtgacaccaccatatcctgccaagaatgctgagaaactatcatttatattactggtgggaatgtaaaatgtctcagctactctagaagtagtttgtcagtatcatttaaaaaagtacagaatgccttatccaccatgatggtattacacgtagcaccatttttgatcaagaaagtcatttcacagcaaatgaagaatggtaatgagcctttgctcgtggaattcactagtcttgccatgtttcccatcatgctgaagaagcgggtttactacaatggtggaatggctttttgaagattgagctacagtaccaggtaggtgacaatgtcttccagaggtaatgtctttcaggatgctctaaaataatgtccaacatatggtgttatttctccaacagccaggattcatggattctgtaataagtattagaggtaaaaatgggagtggcttgattcactattactcctagtgattcacaagcaaattttgtgctttctgtcactatgaccttaggctctactggtccaaaaggaactaagttcttttggaacttagtggttccaacgttgaatatataatttcaacgtctatatatattcttatatatcttttggaacaaactaaggaactcttatttccaaaaggaactaaggttacagtccctggaacattcttcatgatagactctattcaagtccataaaacaagtcacagtaaatttgaaactatttaaatcatatagaacatcttctttggcacaatggaattaaataataagtcaataacaaagaagtatctaaaaaatataaataatatttgggtcaaagaagaaaccccacaggatatgtaaaagtactcagctgaattaacatgacaacaggctatatctaaatttgtgagatggggcaaagcagtgcgtagagtggaatatatagcaataagggcttatatgttcatagcagacttattcataatacagagaaaaattggaaaaagcacaaatgtgtattaactggtaaatggataagccaactgtagttaattcatataatggcacattactcaaaaataaaaatgaacatactactgataacgctcaacaacatgggttaatctaaaaaataaaaatgctaagggaaaaaagtcagagaccagaaagcatagagtgtatgatcccatgtatttgaaacttagtaacagacaactaatttatagtgatagaagtcaaaagagtggttgcctatgcagactggagattgactggaaacagtcatatagagaaactttctggtgagatgaaaatagtttatgttttcattatggtgttaactacaaaggtgtatgcatttgtttaaagtcatctctaaagtagtcaaactcacagaagcagaggatggaatgccaagggttctaagggctgtgaggaaagtgaaacggagaagtattagtcaaagggtataaagtttcatttatacaagtcctagagatctactgtacaacatagcacctacagttaacaatactcattgtatgctttaaatattcctaagagggtagatcttatgttaagctcttatccccacatacacacaaataataaataagagaacaggaggaaattttggaggtaatggacagacttatgacatagatagaggatggtttcatggtgcatataattatctccaaactcatcaagttatatatattaattatgtatagttttatgtatgtcaaaaatattaagtaaaaaagaatgctgaattcaataaaagtattcctttaaacagcaaaatgtaattagaaaactcttttgtctcaaatatagaatttttttaattacaaatgaacaaatttaaaaatatgttagataaaatcactgacaatagatccatagggactactgaaagaaattagaatgtttttcctcccagaaatactactacgcatttgaggttggtattagtgggacatatgatgatttcctaataaagtcttctcagaaacagaatgctggattggctagatgacaggtatacctaatcatgggctttttcctttttttttttttttttttagacggagtcttgctctgtcgcccaggctggagtgcaatggcgcaatttcggctcactgcaacctctgcctccccgggttcaagcgattctcctgcctcagcctcccaagtagctgagattacagatgcatgccagcacacctggctaatttttgtattttctgtagagatggggattcgccatgctttggccaggctggttttgaactcctgacctcaggtgatccgcccgcctccgcctcccaaagtgctgagattacagatgtgagccacagcgcccggccaatcatgggcatttttacatttctacctatgaaataaagcacaccgggaaaaaaagtcaagctttattcttttagattatgataaatgtgcattaaatacctttttaaaggtccaggatgacactatcttctttctccccaaagatacaagcaaacatgagtcttcccataagaacttattttacatggtattggtatcctagagaggtaaatgcagtaacctaacaaattcaacttgtgagtattggctgtattacagtaactcagatgtatattgattacactgagagatacaatatttgagtgctatcaaacccacaccatattgttattctgcatgcttctcctgcatctgagatgcaaatcagttattctgtcccataactagttatattagaattttaaattgaagaattggaaacaattcaaagttgtagagaaaaatttataaccctctaaactgaaactgacatacccagagcaaggagaaaaagtgacccctcatttattcattcattcattcattaaacacttatttactgcctactatgtgtcagaccctatgttaggtgccaaacatttaaagatgggcaagatacgatcactgtcctttaagaaataacagcctggctgggcacggtggctcacgcctgtaatcccagcacgttgggaggccaaggtggatcatgaggtcagcagtttgagaccagcctgaccaacatggtgaaacccagttctctactaaaaatacaaaaattagccaggtatggtggtgtgcacctgtaatccaagctactcaggaggctgacacaggagaattgcttgaattgcttgaacccgggaggcggaggttgcagcaagctgagatcgtgccattgcactccagcctgggtgatagagcaagactctgtctcaaaaacaaaaacaaaacaaaacaaaacaaaaaaacaaaaaaaatcctaaatgggataaacagataaacataaaatgatttttaaaaatgtttaaggcaaaaataaaaatatgcataaggcaaactgaagtccagaggaaaaatcaaggaagacttcctgaatgagatagtacctgaattgagtcttgcagagtaagtaggagttcacctggtgatgagaaatgtagagggtatacttcaggcacaatggactacacaagcaaaggcaaagccatggaagacaaaagcagcagagtgtgtataaactataaatagattaagtgttttgagcaagggagtgacagaatccaacttgtgtttgaaacataaatgtctgacagggtgggggatgcattagaggaaataagggaggcaagaagacaattaagacaccattgcagtttagacaagtaatgatgtggtgcttaactagggataaggcaatggcaatagagaggacagaagagactgtggtcagtggtcaatttacttaattttaagataccacattcttttgattttcctcctactcctgctcactggccattctttctcagttttctttgccggttccttgtcttctccgaaactattttttttttttttgatggagtctcgctctgtcacccaggctggagtgcagtggcacgatctcggctcactgcaacctctgcctcctgggatcaagcgattctgttgtgtcagcctcctgagtagctgggattacaggggcaagccaccacacctggcctaatttttgtatttttagtagagactgggtttcgccatgttggccaggctgctctcgaactcctgacctcaggtgatccacccgccttggcctcccaaaatgctgagattacaggcatgagccactgtgcccagcttctctccaactttttaacattggattaatccagggctcagttcttagatctcttctctgtcttcactcccacggatttctttggatttaaaatactatgtatgtgctgaacactcctaaatgcatagctctagttcagacctgtcctctgtgctccaggtttgttttctcacctaactgcttgacatttccacttcgatgtctagtaagcatctcaaaccatcaagtctaaaactgaactcttacatgccaagcttactctacctacagtccttcccatctcagtaaatgtaacctccttcctcagaaggaaaaaacttgggttcatccttgacttccccctttcacacaccatatccaatctattagcatatcctgtttgttgtaccctcataatgtatctgaatctaaccactcctttccattgaacagtttccaccctgcttccatctaccaccatctcttgcttagattactgaagcaacttcctatctggtctccctgcttccaccttgctcatacacctgtaatctctttttaagatagccacagcttctgcacagagaaggaaacaaaatgaaaaggcaacctacagaatggaagaaaatatttacaagccatctatttgataaaaggttattatcacaaataaataaggaactcctacaatgcaatagcaaaaaataataataataagtgagcaaagtacctaaacagacatctataaaaatgaccaggaggtatgtgaaaaggtacccaacatcactcatcatcagagaaatgcaaatcaaaaccacaatgaggtatcacctcacacctgcttgggtgaccatttatcaaaacaacaacaataaaaacaaaagataaatgtaggcaaggatgtggaaaaaatgcaactcttgtacactgttagtgaaaatgtatattgaaacacaatacggaggtttcttaaaaaattaaaaatataactaccatatgatccagcaatctcacttctgggtataaatccaaaggatctgaaatcattatcttgaagagatatctacactcccatgttcactgcagcataattcttaatagccaagcaatctaaatgtccatttatagatgaatgggtaaagaaaaggtggtgtacatacacacacacacacaaccaaccacaccctagaacaattatctagtcttaaaaagaagggaatcccggcatttgcagcaacatggatgaacctggagaatgtcaagctaagtgacataatgaaataagccagacacagaaggaaaaatactacatgatagcactatatgatgaatataaagtagtcaaactcatagaagcagaaagtagaataccagggtttccagggcctgggaggagagtgaaatgggaaggtattagtcaaagggtacaaagttttggtcgcaccagatgagtaaggcctacatctattgtacagcatagtgcctataagttaacaatactgtatggtgtattttaaaaattgctaagggggtagatcttatgttaagtgttcttgtcatatacacaaataataataaataagagggtgggaggacagttttggaggtgattgataggttaatgacatagattaaggtgatggttttgtggtgtatacttatctccaaacttatcaagttgtacacatgaaatacatatagcttttttatgtcaatcatataccagtaaagtggtttataccaataaagtggtttaaacaacaaaaaagacagtagccagcataatccttttaaaaaccacattatatcactcttctgctcaaaaccctccaaggactcctcattttactcaaagtaaagccaaggtatttacaaggtaaattacaatggcaattacaaggtatttacttaggagcctacaagatctgctccctccctctgttatactcttgtgaattaatctcctagtactccccttgttcattcactctgctctagtcacactagctccttaaaccctagttccttgaacaatccagacactctctcgtctgaaggtctttgtgctggttctttttctctgcttgaatgctcttcccccagatagccgctttcctccaaattcctccaaataattgcttaaatgtcccttctcaatgaggttacactgagcatcccatttaaaattgcaaccttttttcccaccaatgctttcaattctcctaaacctgccctatttcttccatatcactaattgcctatatatgtatacatacatacatacataatcacttatcaccttccagctatataaaatcacttaagactctgagtatgtgtgtgagaggggtgggtgtatgtgggtgggtgtgtaacatttgcctatctcccccttttagaacctaagcaataggaaagggatgttttttgttctcagatgtatttctagcacctaaaacttacttagcacatagtaggcactcaataagtatttgataaataaatgaatgagtatgaaacagaatctgtggtggatgagaaaatagggagcagccaccttagtttaaccttaagaagaataagagaatttgagaacaaaagcctatttgaaaggaataactgaggggcacagggaaggctaatcacagcttccttcttactctgaccaattcctgagctacagagaatacaaaagtggtttatgtctgtaaagcaattatctacatttcctggtaggacacaaaagactgaataaggtatacctcctattgcaaggtacacagcactaccctctcccattacctctaagccaagataccatgaaaactcacccacaccacaaacacaaacacatttggtttgcctcttataaagcttaggctaaaatgaagtttagggatgatctacaggttttaattatgcatgttttctcattctccttaacaaaaataagatttatacctccaatgtctaatctaaacatggactcagaatgttaaagctaggtgggacctcagacataagctaatccaaactcttcctttttcacttattagtttcctttttgagcacacagatgtctgtctttccaaatgagaaatgactatttcagaagtgtatcccttttgaaatgtacatacacacataaactccttctaaatattatacatatcttctccttcctcagtttcaaataggcatcttgtgttgttatgatgaataaaacacttttctctcttgccttaatcctttcttactctctgtagacaagacagggttatatcttttattttgagtaaatgagatatggtttatgaatctaaatgaatacctataatttttggatttagatagaacaacctagacctcatgaaattaatttagttaaaaattgaatttaaagatctgctgcaagacagcattgttccccttcctactaaattaccattctacaaaaatgcggattcttataatttcagttactaaactaaaatgtaatagaagtaaaggtaagaggaaatatgaactatgaggtaatctataatacctgtttttaaaattcaatttcttaccagtttagtctacttttttctatttctgtcttcaaatatgcactaaaacccatatataggggctacatttaactgtagttagtatcttatttcacattaacttacataaattgaataaaagtattgaaatttaagtggagttgttaatgtcaaacattttcttctgtctttctgggtgggtttgtagttgtaagagtcacttgaagattaattatctcttcatgtaaacctctttttctcatttggcttttcggtttcttctcagactgtgttttagtaaatatgtgtctttaaaaatcatataggtgtgagtgtatatatatttatatataattataatcataaatgtgattacatatatgtagtttaatatatatgggatatcatttttgagattagattataaaatgactctggcttctgtcttgggcagtctttcctgaatcaccctctctggggtagccactgacatttcatgggttagccctatggagaagcccgtgtggcaagggtctgaggtctgccaagaaccacccgagcttgaaagtggatcctctccccagttcagtcaagccttcggattcaaccacaggctcagttgcagcttaactgcaagctcacgagagaccttaaggcagaggaattcagctaaaccatttccagattcctgacacacaaaaactgtaagataatgcttgctgctttaatgtgctaagtttgagggtaatttgttacagggcagttgataactaatacaaagtccaagctcaaaacatagtcattgctatgtaagtagtttatgagggaatccatactgtttcctccagtaaaatcacctattttcctcttgtatccattatggctactcatgccaaaactgaaataaacaaatctactttaacaactaaattggacataatcttttggctgggcatggtagctcacacttgtaatcccagcactttgggaggccaaggtgggtggatcacttgaggccaggagtttgagaccagcctggccaacatgtgaaaccccatttctactaaaatacaaaagaaatccaggcatggtggtgtgtgcctataatcccagctacttgggagactgaggcacgagaattgcttgaacacgggaggcagaggttgcaatgagccgagatcatgccactgcactccagcctgggtgacaaagcaagactctgccttgaaaaacaacaacaaaaattggacacagatttttttttttttttttttgaaattaacgaatacactggtcttctgaaaaaacttgcaactaaaatttatgagccaataccaaaataagtttaaacaaaaatcagatttcttaatgactgtgattataactatttaaattctaaagtagttattcattttgaggccaatactgtttgcaccatacatccgcagcaaaagaatatatccgattcagatgaagagcacaaactaaagactagaaggtaaggctaccagcagggtcttggtctgtagaattatgcaaacagacatatcatctgcctccctctggctgcctcatatgtgaatcagcaaggctaaacgatctacctccatcttcactgtgcatttcaacaacactgtgctggcttccaataatactgcctgataagcaaatagagagaatcaatatgtttacagaggtttgtatctgaagatgttgctcattagttatttttcttcaatatgcttatatttaaaagttttgcacaaaactttcagcatcactagctaattatactcatttattgattcactaccatgtgccaagtacaattctacacacttaggaaacatcattgagtaaaatatacagagatcatttaagagagctttcacagagcttacgttatacattaaatcttctattctctgtggaatttgacatggctgatttatatcttcttcttgaaactatgtcttccattggcttctgcaatctgataggattctgttctaatagtctccaattgttttttcagccttcttcaggggctcctcctatcatatcctaatagccgtagatcctaagatttggctcctgggctcctgctttatataattcatttcctcaaaaaactcattcatttcctgaaatccaatgatcacctttctatatgtggcctctcgattttatatttctcattcaaacccctatatagtgattccctatgcatacatatttctattatgcaatctcacactttcaacaaacaagttaataacctagtcatcatcaactacttaaaatgggtttccctgttctttcattttctaacaatggcatcaccattctctcagtcatctagtctcaatatcaatcctcttttcctaatcaatcaagtcctattcattataccattaaaatatctctcatatccattacttgcattccattccagcaactagttcctcaccacttcatatacagataacattgtcctgattgatttctagtctttctatttccaacctctcattcacactacttctaggttaatttccatcactttcatcatgtcatcatcctgaatcaggaacatttaatagtttcccattgccaataaaatctaaatccctaatcttgacttttaaagctctccataatctggctttaatttatttatccagctaatctcttgctattcaccagtgcaaactatttactccagctgggatgatttccttactgtttctaaagcacatgatgcttatgttggccactagaactctgctcatgctggtcatcatgcttggaaagcttggcaagcatcctgttcacttttttgttctacaaaatcctatgtatgctcaagtctctcgttccgacaaatcccttacaacttttgtccacattctatgtttttagaaacttggttatcatctactgtctatgtcactcaatttggatcttagtcatatttttccatattttgctttttcattgtctcagctttcttatatttaatagaattctaggctacttaacagtaagacaagtttcttcacttgttaaccccattttttttttagtagtctaccacagcagttctgaaactctttgctttggaacccctttataattttgaaaaatatggaggaccccaaagagcctttggtttttgtaggttatatttattaatatttactatattataaattataactatgacttgtaaaagtaattattcatgtaaatataacaacaataaatcaaacacatgtcaacagaaataacatgtttacaaaaataactattttctaaaacaaattaaaatcaatgagaataatggcattgttttataattttgcaaatactttttatggaagacagcatattagaaggcaggtggattctaatgtttacttctgcattcaattctttgtgatatgtttttggttaaaatatatgaagaaaatctaggctcaggtaaatatatagttggaaaatggaagaacatttgaatagtcttttcagataattgtagatattattctttaatactacatcaaaatttaacagtggcagttagtggcagtttctttagtgaaatgggaaatctgaatctatattaatgaacttttggggctttgttatattaaaaccactggtcagtcttgtactttaaatggatttttccccaggcatgattttacaacattattcattgatcatttgacaaatattggttcactgagttatgcaaatcttccaatgttacacatttcattacacaatattctcaaattagttaacatcatgactggcctcatcatagaagtctattagcattggtaaactctcaagctcatggtggcagatacgtgttccaaaattctaattctaaattttaacattggcaagaaataccagttgttttccttaaagtcacaggctcactttatttttgagaaaattactgccaaatacccagtgacacagaatagccatagtttgtcagttgttccttcaagtaaaattggaatcctatgtaaaaagctgctagttcagtttgcaactcaaccatacaaatgctttaccttaagacttgcataggaggatgcaaggtttattgaaggatgaataccattgtccttcagtatgcatcagaagtgctttatgtgttcttcccatttgatacatagaacatttaaaaatgtacataaaggtcaaaatgtaataaactaataatagttactgacttataaaagacattactgagaatggctttttttcttaactgtgagtgtgcagcagtaaagaatacaattacttggaagagtctggcaattcctcagatgactaaacatagagttacatatgatccagcatttccactcctaggtatattcttaagagaaataaaaacatatgcccacacaaatttcatagaattattcataatagccaaaagatgagaaattcccaatatatatcaatcaataaatgaataaacaaaatgtggtatatctaaacaaaataaagaatataattactaacaaatacaatttggtgccactctcttaatttccgccaaggtaccagtggttttacccacagttgcttttgctccatcagtgaaaatgtcaacatggtgaaaaagacaaataacatattagaattaaattgttttgaccgctcagactccctggaagaatcttgggctcggagcccccggtgttcatggaccacacttagaatcactggtctacactatgcctgaaactctttcttcttttaccattatctttggtcacttcactggtttcttattgggctcagaccatttctctttgcattgtaaatatactatacgagtgatataatccacataaatggtttcagctaccacctataaactaataatgctcccaaatctatatctctaatgcagacttatttcctgacccacagatctttatttcttactgatatcctagatacctccaaattaatacacccacaatgtaattcatcttttctcccaaatttactcctgactttctcatctagggtattgatacctctattcatccagtcactggacctagaaatttagggatcaacctgaacttcttcctcttcctactcataaaatggtcagcccaggcaacatcaatatgtgatataatacaatagggtattgcagagcctaagtctaattggagaatgtatgttccatgtaagagcattcagattcaaatactgtgtgggccaaacaaaacacatttattagttgccagtctgtgacatctagtaactaaaatatctgtttaatttgtaccttgcttttcatttttagtgccactctcctaatttagatcctccatcatcctgcttggactactgcaaatagccttataactgatctttctgcctccatttttcacaaatcctttcccctttccaacacatccagatttatctttcacgaggcaaacaaagtagtctttctaaaatgcaaatctggtcacacatttgaaacgccagcttaaaattccaaaatagttcctaatcacctatttaaaaatccacattccttagcacagtgtaagcgtataatctgcacctcccaacttattacatcaacttggtttttctccactttcctatccacacaccaaactccagctaccaaactcatgagtggaggccagacttcttaatcattctcatgtgtcaggcactgttctaaattacatataccaactcatttaatcttcacaaccatatatggtaggtgtcatttctaagtccattttacagatgaggaaactcagacacaaagccacattgatcattgggaggtcattgacagtttttcctgattcaggattctgtgtctttgcaaatgctattccctctgactgaaattctttttgttctcttttctaacaaacttccaccatccttcaagactcagatcaaatatcattcttgagctaccttctcttgctacctccttccccaggtaaagaaaggtaggtattccttcccacatttagagcacaaagtacatattaaaacttaacagaaataggcacctgcctaaaatttagcacagcataacagtggcttaccagtagtatgcaggccttgctgtaagcaatatgctgtatcaagaactacaaattctactttttatgaaagagagagaggaagaaggtgatggtgagtctgttcttgctctcccttcctatccccactcacctcaaatcaccatcacatccctttggcagatagtcctttagagatgatccaagtaaaagccatcacttccacatgttggaagtgatggggtcttatctggggtcttaaaatctatgaggcttaaacccacttcataatccctcaataaggtgatgcctgtttggataattggaactgtcaaaatcaataagaaaagtttaaaaacagtcatgacaagccactctgaaatgaagaaacaactgtaagtcactgattactatgatttttacaaagaaagctatatcatctttcgtaaattgagcattaaggtataaaagctccttattctctaacacatttagagtttgaatacatgtaatccggcatcttctgctaggcagggatttaatgaacattttgtgggaacatctgtttgttatttatctttgtctcattttacacatcagcaaatcccattctaccaccaggacagaataaaaatcaccatttcattacacagtgttcataattttaaacgtcaactggggggaagagaggcaattgtcgacactgtattctacctgatgttacaaggagaaagtacaaaggtgaggaagtgcagaggggaaatgattaaatatataaatccctttaacacacaccttgccaattgctacttgttttactgttccagcaactgctgagaattaaaagccactctatctttctagaaggacattcttattttgccctcttaagtctatgtcaacctttttctgtgtgttttaagagagaaacaactattgggcttgccaggtatagatctttgaatatttgggaaacaagtgagagggagggagagagggagggagggagggagagagagggagagggagggagacggagagagagagacagagagagagagagagagcttctatattttcttcaatgttactattccattgcatgaagtcatcaaatagcatttctatatgcttccactagtcgttatgagaaagagccagtatcaaggccatcaggaatgaccaccagtaccatgagctaaggctagtgcaaagaagggaaagaatactgccaatttagtccaagtgactaaagccattactgtataacatatgcatcatagtatctacttgtaaattttgcatgttttaagttagatagtaatattgagtgaaatcttaattgtaacagtaattaaaggtgatttttccctaaatccaaatatattgttctatatgccatggagaatactaaacaaaggaataagaaagtcacagtccttgccttaaagaacttgcaatcatttcctcccaacagtcatttgtagtacatataaatcactagtcttctataagggggaacaagtttggcacatacaaactcactaaagaacaggagaatatataacgcccaatcaaacattagattgggtagtacagacaataaatactgctgtagttcaaagaaggggaaaatcaatgtaggctagcaaaagaagaggaggctttctgtgatgtacaggatttgagtcaggtgagttgaatacgatttacaaaggtgaagggcgaggacaaacaatcaaattaactaatattatgtgcctttatcctatcccaacactagagttctttcccacaaaagcattttgaaagtccctccccataataccatcaaacaggtaaagaaagagataaggagatgcacacatctcccttacaccttcttttctaagccaccgaggaacagaaacctcagttaggaatcgatgcagatatttgattcaagtaattgatgctaaaatatggttaagggttaacctcaccatgagacattatatcttaaaagaggaggtcatgaatcaatacagaatctctaattagtttaattatgtggaaaaagtatttttaaagctgggcaaacctcttagaaactttttcttctatttgtccattttagacaatggtgttccttccccacccactctgctagagcttacaatatgcaggatcactgggggtagcaaatgcctttccttttatgtgcaagaactactttacctcattgggctcctcagtttttggacatagcaaattgctaatactagaaaccatctgacaagttgttctaagtaagtttctattttcttcagcattagttttgttctgttttattttgtaaggcaaaagcacgtattaagctataggaacttatttaaggttgcttaaaaaattctcatggatgaaacagtagtcatttttatttatctcagtgattttcagctaggctggtatagcactcactgaagatcatatcagaatcttcgagaagtctttttcaaactatgtctccctatgtctaatattgcatgtttccgcatggtggcatatctcttctctacttgatttcagcatcagcctatgtttaatacttacaaagtattacttaccttcattcctaacctacctctgcatggcagatcatcatgctaatggaagcaatgaaggaaggaaagaaaaagaaggaagcaagaaagacaatcctaagcaaaaagaacaaagctagaagcatcacgctacctgatgtcaaactatactacaaggctacagtaaccaaaacagcatggtactggtaccaaaacagagatatagaccaatggaacagaacagaggctgcaaaaataataccacacatctacaaccatctgatctttgacaaacctgacaaaaacaagaaatggggaaaggattccctatttaataaacggtgttgggaaaactggctagccatatgcagaaaactgaaactggaccccttccttacaccttacacaaaaattaactcaggatggattaaagacttaaatgtaagacctaaaaccataaaaaccctaaaagaaaacctaggcaataccattcaggacataggcatgggcaaagacttcatgaataaaacaccaaaagcaatggcaacaaaagccaaaattgacaaatgggatctaataaaactaaagagcttttgcacaacaaaagaaactatcatcagagtgaacaagcaacctacagaatgggagaaaatttttgcaatctatccatctgacaaagggctaatatccagaatctacaaggaacttaaacaaatttacaggaaaaaaaacaaccccatcaaaaagtgggtgaaggatacaaacagacacttctcaaaagaagacatttatgcagccaacaaacatatgaaataaagctcaatatcactggtcattagagaaagccaaatgaaaaccacaatgagataccatctcacaccagttagaatggtgatcattaaaaagtcaggaaacaacaaacgctggagaggatgtggagaaataggaacacttttacactgctggtgggagtgtaaattagttcaaccattgtggaagacagtgtggtgattcctcaaggatctagaactagaaataccatttgacccagcaatcccattactgggtatatacccaaaggattataaatcattctacaataaagacacatgcacacatatgttaattgtggcaccgttcacaataccaaagacttggaaccaacacaaatgcccacaaatgatagactggataaagaaaatgtggcacatatacaccatggaatactatgcagtcataaaaaaggatgagttcatgtcttttgcagggacatggatgaagctggaaaccatccttctcagcaaactaacacaagaacagaaaaccaaacacgacatgttctcactcataagtgagagtggaacaatgagaacacatggacacagggaggggaacatcacacacgggggcctgtcagggggtgggggactaggggaggaatagcattaggagaaatacctaatgtagatgatggattgatgggtgcagcaaaccaccatggcacgtgtatacctatgtaacaagcctgcacgttctgcacatgtatcccagaacttaaagtataacaaacaaaaaaaaagaagaaaagcgaggagaaatttttaaaagctagaggcacatacagtaccagctttctacttgactaagctttcaaatcctgattgaatgctcttcattcttaaggactagctttctattctccatactctaactaagaagtgtgccaggctgtgtttgtcatgtcctagaaaaccacttggtaaatactttgttccatctgtaattgaaaaacacatgacctgacacttttgacaccatctaggggatagagtgtgagggaattagaaaggttctgcggatcaattgactccttggtagtaaagagtgggaagaaagggcaaaagccaataagccatcatcacagggttggcagcacaggtaatcacaacagtggaggggaatgggtcaactatggaaatcatgtggaactatagcttaataaccaagaagaagcaaatgcagaaactagtgcgaagcaagggaatgagatacagaagaaggaaagcaatgaaataaaagataatacccttttcaggtggaaaggccaaattcatctgtaactccaaaatctcaataagctcatctaaaaggatgaaatgccacaaagcctatttgtaacattctattccattatcaaaaggcatcttgctaggatccaaaagaaaaaacaaaaaacacaacaacacatatacacacatacttgtgcacctatgcatatgcacatatctgcatgcaaggattaaaacagaaacatgtagagacatacacacagccactccccgcccacacagacactaacaccaacacatgcatgccccccccgacacacacaaacataggcatgtgtgctcactccaggatgggtctgagtaaaaagaaaccatctctgacctagctaattttcttcttcaacttgttgttcttggcttcttcactcaggaataatcccaatcaaatgcaagaagtgtgtgagtcactaaacagggcacttaattttggttgtcttatattacatatttataccatggagattctggctactttttaaaaagtagttttaaaaggtataggtttggttctgaagtggtgttactggtgagaaagggtataggaaaactatgtacagagtcacctctcatgggatcttattctaagtgaggtgtgtgccttttaaaaatcagtcactctctataaattcagagtaattgtttttgaaatctaagctggctttttttttttttgcacaaattgacacactgattccaaaattcatgtacaaatacaagaaacccagaaaaaccaaaacaatcttaaagaagagcaaagttggaggactctcatttcctgagatcaaaagagtgtggtactgacataagggcaggcatatagacaaaacagtgtggtaacaatgtaagggcaggcatatagacaaaaggaataaaattgagtgttcagaaataaacacttatatttaccttcaattaatttttgacaagagtgtcaagaccacgcaacagagaaaagtggtttttcaaacaaatgatgctgggacatttggatatccaggtgaatactatagttggatccctgcctcacatcatatacaacaatgaactaaaatcggatcataggcctatatgtaagagctaaactttgaaattcttagaaaacatgaaagtgaatcttcatgactttgaagttaagcagtggtttattatatatgataccaaaacagaagcaacaaaagaaaaaaagataactgtgctttatcaaaattagaaatattttcagacaaatgatataatcataaaagtgaaaagaaggcctacagaatggtagaaagtattttcaaaaccacaataagacaccacttcacacctattagtataaaataaaaagaaaggcagacaataataagtgttgacaagattgtggacaaactggaatgcttatttattgctggtaggaccgtaaaattgtgcagccactttggaaaacatttttgccacctcctcaaaaggttaaacatagagttaccacatgacccaggtatatacgcctaggtatatatataccaaagagtaatgaacacatatgtccacatgaaaacttatacattaatgctcatagcagcattactgacaatagccaaaaatggaaataacccaaatgatgactagataaacaaaatgtgctatgtccatacagtggaacattacccaaccataaaatggagtgaaatactgattagtgatataacacagattaaccttgaaatcattatgctaagtgaaagaagccagatgaaaaaggccacatatttcatgattccattcatatggaatgtccagaataggcaaatctatagagggagtagattagtagttgcctagcactgggagttggaggaagggagtataggaaattgggagttaaaggctaaggagatctgggtttacttattttgggggtaacaaaaatgttctaaaattagatttttggtgagggttgcacaaccctgtgaatatactaaagatcactaaattatacacttaaaatgagtaaactgtatgatatgtaagccatacatcaataaagctgttaataaaaacagtcactcggagcacatgatgattgttttccagcatttgaagggctaccagttgcttggcatagcagcaaggggaagtagaatcagggtcaccacactacataactcctcaatttattctgtaggttgtgtggatggtactatgtctaagagtaggagctgaatagaggctgaaaagagattttggcttatttatgcaaacattcaataacttgagctattcaaaaatcagatttcctaccgtatactagagactgttaaattattgggagtatctaagcataaactggattgaccacttgaggatggagtagatatagggaatagattatgtatgaaagggagtgagggaaaatgacttgataacctttaaggtttcttacaaccataaaattcttttaaaatgcttatattacaaaatccttctgaacttttatctataaacctcccttttctctttcttaataattttctcattagctggaaataaatgagtacttacatattcccactagagtcataagtcccaatagtcgtattattatacgaaataataaaacttgatgctgtggtttaagccatttctaatatttatatgctgtttctggctcaatcatttagcaaagggcacatctactggattgctctttccttagtctgcaggtttaagggtagcatttcgtaaatgttagtaagaacaacatcctacattgtacttaacactgataatagttaatgaatacaaatcattccgtactcttttatctccttcctccctcttctgtcctttccccagatatggaataggcaggctgttgatttttacaagttgcttccaaagctcctgaatgaactatttgtctgagcgttttaaatattttggcttaagtccatgaatgccataagaaactggcactccattttgcaatgcttttctctctgtcaataactttaacttgggatcataaagggaaagcatttggcaggtggtccattatgatctagatttaaaacctcatggggagtcgtctactccattttacactttactgggaatgattccgatactgaaaagagagaagtacagatactatgagaaaagctgtttatccatcacctgtttcacaacagcaaggggcagtttactatcctgggaggggcagcttatcaatagtgccctgaggatcagaaatggctaaagagcttcaaatacttccctcactggattggtcaagtacaggcaacacaatacagtaggtgctagctaagtagtgctggctgacttatcctggctcactgacatgtcaaaaatctccaatggaaaacatctgcaatgaaattgtactcattgtccagctagtacaccagagccttactataaatcccaacctcagtgttcatgccttggaactgtgttctaatgttctaacatagcccttctgttacttccagtaataaatccatgtggagatggtccaagaagggcattgccttagatcatattccatgttagagtgaggttcttctctacagcttatgcttcatctggccttaatgtgaggccagccaaagaaatgttctggagagtttgcttcggggtggggtttccttttattttaactagctgttaatatttgacaaaacaattatgtccttctcacttcaattccttcaaaccatttcttctcagaccatttctttcccttcttgttaaatgcctcacaaagcccatgggtagggcactcagggaatactagttgagatggggagagacactactggaattccaggctcatccctccagtggtcatatttctgcctgtgcttattcctttttccgtgagactatgctctttattgctcactccattcaaaagagccgtgagtgccaatattcacgaactactcaagctgtctttatcatatttactttgtgtcctaccttcataaaccactctccctagattccttaagcatttcaattgctcttttccatttcaagcatctcagttccagagaatggaaacttgggcatagtcttactaccaattaaaaagggattctcactactatgctctaagttatttgtccatatccatgtcagttactcaaaaccatattggcttttaaaatgatgtatcacattgcacactcttaatatagtttactatcccctgtcacttgtagatgtataaaagcatgaatcaaaattacttttgatgttttatatttatttgtttgatatttataaccaagacgaaatgtaaaatgccacccataaaacctttccagaatagtctgatttacttgcagcttattgtcatttttattaaatatggattgtcacaattattttacgttcctcatattccttaccacaaattgaggtgaatgcagattgtacaacttccaatgaataagctgggcaaatttccatgactcagcagagtgtgtaaggcttgtggttctttgcaattcctgttccacctccaaaccccacggtcaaggtttgggaaaatgccaaccatgtttggcagcaagagtcagcagtctcttagactgctgggcaagcgagtggcaataagtagagtgtataaagaatctaaagaaggctttctttacaaccccttagtcagaagccctcttaaaacacatcccaattcctgttcaatacacagctagcacaggaagtgttttctttacattctcccattttacgcagatctgggatttttatgagggaacatcctagtactgataatctctcttctctcttcccttctccctttctctccctccctccatccctccctccctcccatcttatctcttcaacacccatacccacagagaaacagagtaagagaataggtaaccattcacaattatgtgtataagtaaaaagcaacaggaatgcaggctttctaagagcagtgtttctggagacagagctctagacaagttagtggtatatatagtctcggctaagaagaacaacttctttatcatttattgagagtactaacaaggattaaataaaataatttatgtaaatatcttagcatagtcctatagcatacctttaaaacatatttcccttcttctctactctggtttaaattaggaaggatcctgatcagagtgaactttttttactgaaagcagaaatgactggtttcctaaacaaagtaaaaatgtcactgaaaattgtagatgtagtctgggggaagggagaggcaagaagttaaaattttcctttagatccaaatgggttttctctttacacatttctcaaaactgtagctgcgatactgtctctttagtcctcaaaacaaaagaacctatatgcagagtgctccagggtggccctgagaggcactttgaaacacccgttttgaactcctctaggcagttcagtgaggttggatacaacaatgaattctgggagtgagtttgaatggtacaaaaaagctggggaggatgcctgctgtccattaaaaacagaaaacagagccaaagaaagtgaagaatggaaagagaaagaagggaatttcaggatgtgctaaaaattttagcaattgaaaagtatacaaagaactgggatctaggcaacagagggcaggtccagcaggcatagttacttaccatatagtttccatagataacaatagtcaaggacattactctatccatgtatttttttttcccagtactttagaaatttgacactgggttctttttaaagccaccaagtacaactaatatacttgatgaactccacacaataacaaaacataaaaggacctacatttatatctctttatgtacagactacattccatttctgatcaacttcttccaaagtattaatgctattttaaataacaaaatagtcctgaaaggaatatactactggttcaaaaaagatttactcgcggaagaaatggaagctgaaaagttgtgagtcatgagtggctaaggggttgaacaatccaaaagaaaatagtgaaagggactatgagagctaaaatgtataaaagtgtctatgacataaacattgaaggtaggagctcttctgattaactcaactttcttatccctagctcagaaatcaagacttaacagccaaccctcaacagcaagccaatatgagaaaaacagtactgatgagaaatgcagagtgcagctcgcatttaaatttagttgagatcataatttgtcaaatcccttctgaggataactcactttaggccgtttttaaaatttaaattatccataaaaagaaatgcttgtcctatatgtaaaaggaaacaacattccagtttgatttcctgttgatacaattatcactgtggccatctagacctgtaagagaattactccttctggatagccaaaccttcttgagctgcactgacggtactacatccagtagccacatgtgattatttaaatatccatttaattaaacttaataaaacaaaaaaattcagttcctcagttgaagtagccacatttcaatgctcaatagccacatgtggctagtggatactgtgttagatagatagtaaagatacagaatacttcatcatctaacacagttccatcaggcagcactgggttagatatcaggaaactaagactttcagtgttcgaacaaaatattcaaaccattttcaggatagtttttccacagtgtaattaatatgaatatccatagagaatacagatcagaatttagcatttttgcctttgaacagtggttctcaaaagtcattcatacaggagaattatctggggagtttgctaaatgcagatcactcagagtgattcagtaggtctgggatggggattcagaaatctacattttacacatgtcttaggtaacgctgtcacaggtaattcctaaaccacattttgagaaacactgtgattatgcatcaaaaattccaattatcactttacatataccgatttcttttcttgaatggtattaaatatgtgtacataggcaagcccttatcgctatacaaaagtgcaaaatgttccacaaaggcaaaagacagctttcaaagtatagtagctctgagcgaggatgagtatagaaaaaaaaaattaagaaggtacttgcactaggaaaaaaaaacttttgaacagaatattccagaatacctatgcaaagcagaagcaatttagccatccagcttcagaaactcatgcttcggaacagctcggaacctttagctagcagaagaggagaaaaacctctggtggtgcagctgctgaaggtctgaatactgcatgtgagtgctaactgtgtgcaagacaccaggttatgtgctaagagacaagtaaaatatggtcatgacttcaagaactcagtctattgggggaagacagaccaaaaataaatattaaatacagtagcaggtataatttgagtggaaccttaaatattgagcagctctacgatcgctggagataaggaaggatggcaattgaaatgtagagaacagtatggaaaggcacaggagcttgaaaatttggggtgtacttatgacccagaagtggtctagagtggcaggtaaataagatatagagagcgttgtgtagtgggagataagagtgtaagggaattctgagtgcctgggacaaggctatggatggccctgaatgtctatttggaaaaaaaaaaaaaaaagcaaaatcctttagaggatttttaaggagaggagtgataggataagatctgcatttaggaagaacattctaacagttaggcataaaatggagtcgggagagagtagacacagagaagatgtgtgatgtttggccatttggctgcatggaagaaaaattacactttggctgtcaatgtttcttgttgcaaaaagctgagaatggagagaagcaacagattatgaaagagaccttaaaagcaaagctgaaaatctgaagaaagaacatgagtagtagcaatgtttagaaattcctggggatgcaatgttccccttcactttgtcagtaaagactaccaacgatgggggttggaaagaaagtaaaaatttttaatagtctggtcagcagacagctctacactgtctaggtcttttgaagtcatgaacaatgggatatctgctccgggtagcacacaggtgggcaaacagtttctttaataaagaacccctaaagacatacagcatactccacagtggttaagagcattggctctgaagacaaacttgccatccaatattgattcttgctacttagtaattgtgtgacgtggtaggctggatacttaaactctgtatctgtttttctaacctgaaaatggaaatactactgtctaccttatggcattgctgtgagcgttgatgagttcatacatataaggtatttataacatgatctggcacagagcaagctttcaataaatgttagtttgttttttgttttgttttgttttgtttttttctgagatagagttttgctcttgttgcccaggatggagtgcaatggcatggtctcagctcactgtaacctctgcctcccgagttcaagcgattctcctgctgcaggctcccacgtagctgagattacaggaacccaccaccatgcccggctaatttttatatttttagtagagacagggttttgccacgttggccacgctggactcgaactcctgacctcaagtgatccacccccctcggcctcccaaagtgctgggattacaggcgtgagccactgtgcctggccaaatgttagctattcttattattgtgtttatatatggctggggagacacacactcaactgtactatgctcaataatgtcaatcagtatagtttagcagccccatttgcagtatactatcctacataaatagcatgccttaattattgtattattcataataagcatattaagtcctttttggaaaaaggcaaatatgaataaattttcgaatttgttaatattcttggtgatccccttaaataagctagtgcaagctggctccagcacaccacggactggtgtatactaacctttatattcccgtccatgagacctgcccttcactcctctaaaacacgctcataggtgtaccaaagaggaaaatccatcagacgactcaacttcagctccctgaacaaccagaacctacaaatctccctcttgaatttttcttggcctcaaacaagacaaggaaaaagtaactattttgtagatgaaagactttttctttagccaataagaaaatgtcaatttctttaaaagccccaataaattctttttcatttatattcagagtgcctattcctagaaaaaggaacacagtgagggatgttagccagagcttccaactacgtaggacatttgccacctgaaaccaagtttaatatggaacttccaatttcatgcctagtttgcccagttctccttcctctaatcctgatctgttccccgaagttcccacctgtattttttaagtgtcaaattcatttaagtctaaagaatgataaaagggcttcatatcatcctcctttcttttttgccagaaggaaataatatgaggacagatttactttaagacatgttaaaatataaagataccatcttagataagggtaaattccaattacatggtatctgagataatatattcattaccatcttaaagtctcataaacagattataacaatacttgctctatctctggcccattttcttatcaacattctcaaatgttcattgtcaaatgctgaagaagagttgtctatggcgtgaacatcgagtcattaatctagtacacgggacagtctctaataaattcagatataaaaatggccccttcaagaatgtttactgaaggggtcctaaagaaagttttaccagagagcttgtatgagccattcaagtagttgggttcatttgatgaattgataatgtggctttaaatagtattcctttcttcagtgggacaaaaagcattttttcccttaaaactaattaatttaaaattgagaaaccatttggaaattttaaaagataagaatgctgatctatgagagagagagagagagagagaaagagagacacagagacagagacagacagaaagaaagaaaagtgtgaacctgaattagctgtatattttttctgctgatctggacaaaatactcaaatttcaaaaacatatagcacttcacattcatagccagtatatcttaaaatacatatactttcatggaaacaatcttataagttcatccagtacaacagtacaaacaaactagctttttagaagagaaaatactccatactaaccttttggaatagacaacattttgcttccccaaaatttcacaaagctctactttcattcatattgatgtacacattaatcaaaacactagtgtttcttacacatctgtaaaattaatcttgaaatcacacacatattcaaataaatgctagactaaaaatagttttgaaaacatctctagcgtcctatccaagaatacatttttcagtaaatgaccaaatttatcctccttctctagtagcataagtcacatttacctggcacccatcaaccgagaggcagcctgatatcagggaggaaaaagcacagattctttaatcagataatgtaacctgtaagtttaggctgcacttagatggagacctcaggccagttactcatcctgagtctcagttttcttacctataaaatggagatcatatcactgacctcacacttactgagaatgaactaagaaagtatatattaaatcactgtctaaatgttttataccacatccactatcattcagtaaccaacaactacactaatattgtaatttttaatagagtaaaaccattaaggaattaaacatgtattcactattagcatacaaataaaatacagtcataaaagccacctagttagatttgaaattattcattaggtcactgtggaattgagagctggcaaggagataatgtcgtttttaaaatgtaaacatttttattagcagagagaagttcttcccagatatagtaattccagtagcataacaaagtccagcatttttcattgccagaaacttaaaccagtaacactggtccatgagaaatctctatttattcaacaaagcaatattttccatgtaaatctatttaattttatagtggagaaaataagacaatctctggttttaaccgtaagaaaaaagcctcaacaacttctcacattaaaatgtacacagaaggctcttctagagtcaagcatgcattggaatacagagaaaacatccagcaagcacaactttccaacacttagcagaaccaaccaaccaatactcaaagaagaaactgaagctataaattcaaataaatgggctgcagggagactacacaaacctgctgttgctttaattgcagacaattcaattcagcagctgttggtccaggcactaaggttcactgtatgctcttcaacgtaaccttgaaatattgtcactcactcacttctccacatcatctgcatgctgtccaattaatgaggagcgaaatcaactgtcaaaccacgcatcaaaatagaacatgatcttttagctgttaagcgtaggagcataatattttaagaataataaagcaacaatggagatgaaagtccttgacaacaaatgatattcaaacttatcaaaacaacgtggttgtaggaactaagcttctgttctgtgaagcaagaaagtgaaactttctcagggtttttcatttgcaagggacctttctgtctaactgctgtgtaagaagcctttcaaaaaacattcgcccatacctgatcagaatcttcttcattattatggaccattatgtttctgaaagcttaagagaatacttaagaaacacttttgatccaaggatattttacaatacagatggtttggggctcgtatttgtagctttgctgtttccagcacttttttttttctgtcaggagaataaacaaacaacaataatatataatgttcatcaacctgagttcagtaatgaaaaataactaaatttaccaaacagatgtgtcctggaatgcttcctgtttgaagtttccctactcttaggtatatcccaaatctatacaaccaattaacaaatacaggagttaataaactctagagaaacataacacactaagtgtttaaaaattgctttttgcttccaaagcactgtcttctgtgcaaacactctaagctatatcacatactaccagttgcagacataagacttgagaaattcaatacaagaatacagcagagaagcgtgcacaattaagggatcgggactaccagtttaacagaaaacgcagattttatacagcaatctgctacaaacattatagctgggggcaggcatgttttatgcagctattttgtttagctcattagaaccctatttgtccttcagtacagttgaactgaaggaaaaataaaagaaagaaatgcactttgaaacaaaggggaaattcagataaaacaaaacatactatacctgtatattgtaccaggaacattgtgacactcttcagggaactgtttcacgttgtatcctatcgtgagttattctctccttaccctcttctctccacaagaagaaaagccaaagcaccccaaacccccactataccctatccctaacccacccaccccattgaggaaaaagaaaaatagctataattcagcttagatctgacgcttctgtttagctcagctccagccgagcaactgagcttcagcaacggagcatagggaggaggattctgatgccagtagcacttccatccacttcacttacacaaaagcaggcagtggaaaatccaggagccttgaagacaagggctggaactggcttttatgaattgctattactgcatgtgtcaccatccatctccaatgacggacacttataggctgaattgggagtggagggggtggggtggaggaggttggagagcaggtggagaagcaattagcagtatgttcattggagaattcgttcgggatttcatacatcagtgcctaaagaaacagcatgcagttgacaaatcagaactttacgatttgcatgccttggaagaaatcttagctcacagctccaaacaaaataatgtttgcccactcttacagggcacagaaagtcacccctttgctttttctttcctctggctacccttattcctgagaaatcaacattcagaatgaatatttgctaattttccctaaagaattgtatttttaaaaggctggaagcaaaggaagtataaagaaattaaattctattgaacatgacatctcttaacacaaaggcaagaagctaattattttaaggcaattcttcatccctagtcccattccccaagcgcagctttcacacctataatcagtggatcacacaacttttgtccatatatttaacactgaaaaacaaatctatgtctacctaaaaatagttcagttaaaatgaaggtgaaaagccaagagctatgtgcaggacccacttcattaggtgacttgagaaagcactttacatgtaagtgcttcagttttactcatccactaaactaaagctcatttttagacggattttaaaattaatcacgagtaggaacaaaaaggagatagtgtctttgggaggaaacatgatacaaccgaaggagcactggggctgggtatcaggaaacctgggttcagcttccagttctacaactttctaactatgtgactctggccaagtcacttaacttctttgagcctaagttccctttatttgttaactggagataatagtacctatcctgactgtctcacaggattgctgtgaacagctaatgagataataggtatgaaaacccttttgtaaattgtaaagggttatacaattgtatgggattattactaccatgccctaaacaaatcttgccttaatgattgaagtgaggcacctctatcacataaggcaaataaaaagaaagaactaatataatttcatgaaacactgctcaattcttacaatttttaaattagacggaatcgctgtttgctcttaaaattctatagcagggaacgtttttgagaaaattttaaaataatacatcaaaagtttattaaagagactggagccctctaaattctctctttcctttctggaaagtcagtccatttttcttcatatggtctagcattatgtcccatctggaatgcaaactactagataatgagcatctccttttgttcaagctttctatttgcctgttacatcctcattgcccagtgtgttgggggaggattcaaggtgattaactaaatctaaatccacaaggtaaaaatccaaagttatgctttatgaggctccaagctgccttgatcctatgtatacagtgaccagctggcttcagctgggacacaattttagcacatgaagtcctggggtggccacacctggggcactaaatgatccaggcaatgtttggggatctttggttcagccaaatcccacatgtcctgatttccatctgtatggtggttcccaagtgtgtttgtccacatgaaccaaatctgaagcagccaaaagaaaggtgggggatagagcagggatatcagatgtcagctcctcttggtcccatccagtgctatctgtgccctcaaacaagtgcccatcctacttcttgtaagaagaaagaaaactttttctaattgcccctttgaacgtcattgctactactgaagatgccagtaaaatatatatccaaaatctatgttaagccaattgggaaaaggataatattaatcacataacaggtaattggtagctaagagcaagtgagctgctgaaagggggaaggggagaaaaagacaagagaggaggagggaaacagaggggaggggtggagaaaagagaaaatgaatctaaagtgagagctttctaatcagaaacatacttgctgaaatcatccaaagtctcacctactataataaaaagtgcttgtcttttgaggtattgggagtggccccctaaccatcaaagctgcaaacctagccttccaactgcttagggaaacagtcaagagcctgaaaaggtactgacagccctagcaccagatctcactttcctctgccattcagaaagtgagtcaggtgggatacaattctccagaggcctcatccctgctaccgtccaccacagcctcactggcagcatggctgcccactaaggaaggtgtcagtccaatttcaggttcagcaaaggaggcttgcctgtgacttttaaaaccacattggtaagaaaggaacaaaggctgtatttcagaataggactgttctccctttgggcattgcaactaaactccttcacaaatttaagcttgaaattcatattccccaagttcctcagaagggccattcaaagtaaagggaaaggacaggaaagatgattttttttttgttagcttctttctgacagtcaaaaaatgaggaatatgactgacagagtgtcccaaaaggcaatgaggtgggaggcagtagtttcaacccaggttagcaagaagggcaatgaaagcatccttataaaaacaaacacgcataccaaaaaccattgcactgtttccattatcccgatttcaagctccagaatgtaagcactaatggttccctaaaccacccaagctcctcctcggcagccgtcaccaagcctgactgatttttttcaaatgaatttccatcactagccaccccagattctgagtatttttgtcaaaaacaaaagtcctagtggaagatttcaaagaactaagaacttgaaccaaaccatgaacttaaacgggaagacacagaactaatttgctaaattccaaacaaaacagaaattgtaacagtttgaaagcaacaaaaactagcaagctgatttgaaccagaacaaagtttcatgttttctgaatcaatcaaacttgcaccaaaccctgagagtctaatcagctcaagctcctgcaaagaacacacagcaaggtttggtttcacctgtctgaaagctgacaagggaaccacagaatgaacactggataaggagtcagaagaactgacgtctcctgattttcttcactgtttgatcttggtcaagtcacttctactctcttagcctcagcttgcttgccatgaaatggccaggctgggattgccaatatcccaatatcccagttttaatagtctatgccaactgtggaatttagtctagtgatgaaacagataaagtcacaatttagccttaatctgcaggaggcagagagatggaccaccccaactcttttaaggattcatgtttctagcttattttgaaatatacttggccgggcatggtggctcacaccaataatcctagtactttgggaggcccaggtgggaggatcacttaacctcaggagttcaagaccagcctgggcaagagagtgagatcccacctcttaaataaataaataaataaaattttaaaaagttttttttttaaaagaaatacacttcatttaagagttggtaactgtccttgttcagcctcagaaataacctaatatactttttcagaatgtctctcctcaaaaaaatgtttcaggaatagtttgttttcctcaagtgaaagttacagatgagttgtttggtccaataaaaggaaaaggaaagaaatgacagtgatctagtataggctgagcccctattacatgtcagacatggcaaattttacataattttcttaaccaatcttcacaatacaacactatatggttttttttttttttttttttttttttttgagaaaggatcttgctctgtcacgcaggctggagtgcagtgacacaatcatagttcactgtaaccttgaactcctcggctcaagtaatcctcctatagcagacacttttatcctcactttataggcaaggaaactaaggcttactgatgctaagtgacttgcttacagtacttgactggtactgggattcgaactcaggcaatttgaatccattactataacaatatcttaagaattaaaggaatagttcttaattcactgattcaattggacttgcttagtgaataaattacatgctgattcaaaacagtgaaagtaaatttacttgcatttatactgggttgacatttttttaaatttcattttacagtttggtataacggttaggaatactgggctctggagtcaggcagacctgaatttcttgaattctgtcttatggacaatacagttaaccatgctttgtctcaagttttcttatctgaaaaatggggaggaagtagtccctaccttgtcaggctgttggaaagtgtcagtgatctgatagcatctcgcatagtacttgacacaaaatgacaactcagtaaagaccgatgaaagctatccttgtattcacagcaatacaagaaagaaaaggttataaaggaaaacgacactgggattcactgaatttaagtgctctttggttatagcacagatatagtttggaaggttttcagtggtctccgtacattctccaaaactaacttgcatcttatggtaaatcagcatattcatgaagcaacatgaatacattaattggggtttcctaaagagtagcaaggaaacttgtcatgtgctctgcttagcagcagttgtccctagtttcctggaacccatccttttaaagaaaaagctcggaagtagcagacagtactgctggaagtaccaggcaggtggagacatcctgctttcccccaattcttcaagccctggcttctttcctattcacctgtggccctcttctcagattcccttctgtccttccccagtttattctggttttatcatgattcttcctctggcactagctctgtttctgctcatcagcatcaagtgctgtctatggaatgtgtgccttgcacgacactaggtgaaatagaaagtcatccaagagttaatgaaaaagacatgtgatccatggccaaacagatctaagatacacagactagagttttggcaacacagtaaatgcaggtataatgcaggatgacttggttgatttcagagcacaaaagagtttgttcatctagttaatgatatgcataaaaaaattttttaaaactgtactaatgtctgccacttaatctgaaatgcagaaaagaatggatagattaataggtgataaagcaaatacaacaaaatgttcattgtagaatctaaatggtgagtatctgggtgttcaatgtgcaattcttttaacttttctctgtatttgaatattttcacaataaaaggttgacgaaaaggagagggggaaaggggtatggcttattcaaccacaagtgtttcagaacaaaataattataattatatagaaaagtataaagcaaatagggcaaaataataacaattggtgaatctgagcaaatggtatataagaattcttatatgatgcttgcaatttttctatatttaaaagtacttcaaactagaaagttaaaagataatttgttgagcaccaacctcttttacctagtgtctcagttgccattttcagtagtgagggcattgggttaatagtagagatattggaaacaatggtggaagggtggggaaaaataacagtcacagatatatattgggggcctactatatgcaagacactgtgctaggcactttggggaattcaaagaagtaaaaaatacagcccctgagagggctcccactgtaagtaatggaatgccaaagcagtgtctgaaagggtaactggctggagcagagttctgtaagacagaagtacaaagattagaaaggtaggttggagccagattgcagacagtactaaaggtcaggctgaagagtttggacttcatcctatggataatgggaagccatttacagtatctgagtcagggaaagaacatgatctaaaactgactggctagatggtacaatttgtttgggcacaggtaccttcaacatgcatttgttttatattcatgtacatctggtacgtctatccacttcccatatctggatgtgacgtttaaggatttccaacatgctggttgctgcttatttttcaaatagccacttcctgacatctcttcagcctttcctttttcctcccccaaatcccaagggcagctgaccagcacgtgcctcagccctgctgactcagcaagcaataaatacgcctcatagaatgcttttgaaatgaagctgctgtgcttcaaaactgatttctttccttcatgataatcaaacctcaattactgctggaatcactgatttgagttggaaagaatgaatattcatctgagtaacatgtgaaggagtgcaggaagttatgtcctgtgtgcagaaggaaacaattgttcaaagtgatctctgtatatggaaagaaaccctagcagagatggcattgctgaatagtagcaagtgattagggtaaaacctctcaaagactgccaaattagaaagtggactttataatcctttggatatacacccagtaatgggattgcttgggtcaaatggtatttctggttctagatccttgaccatggcacatgtatacctatgtaacaaacctgcacgttctgcacagtatcctagaacttaaagtaaaatttaaaaaaaaaagaaaaaaaaaaaagaaaatttcctgatgtctatgatggtattgtagctatatatggaatatccttttttttttttttggtagaagattcaaataaaatattcagaaatgatgaagcatcatattaaaattttattctcaaatggttattttaatattctttataccattctttcaacttttttctaaattgaaagtatttcaaaataaaaataataaaaaaaaagaaagtggacttcatctgtcttcagcttttccccccatgaagtccaacctccagtgcaatcatgttactcctcccatttaaaaccctgtgttcactcatccctacatataggacaatggccatacttcttagcaagctgacttacttcacccaaccagccacaggatacctttccagactcttatcctgtccccctttcccatgctttcagtggttcacacacaatatcttacctttttctgaactatgcagttttacacatttgactgccttgcatgtgttgatggtccctctgcctggaatccttgcccatcacctctttgtccacatagagactaggcaatgcccctcatcctttatgattcagcacagttagactctgatctctaagttgtccacccccagctgtaattccctcctccatattcccagaacaccttctctctcttttgggtgcttttcacatcaaaatacgatcactggtttgagtgtctatctcccctattagactgtgagctccttaagggcagggattacatcacatcaaattcattattatagtcctggtgtttagcatagggtctggtcctgtatatatgctcaaatgtctattgaatgaatgagtttgaacatcaagtactccttgaagtcaaactcagcatctcttgaaaggtgaaaattagaatggtatgtgaccagagtaatcctagtgaagtatgtttgaggacctgactgaagaaaagctgataggaggacaccttatgggggcttattgtggggcagtttctatcccaggaaactcttattagcagttgttgctggctaaaaatgaagagcagctggagcagatgacaagggcccttactggggatttctccatccttatctttcatagttcaccactaaagcaatgttgttctctgaagtaacattttccatagtgtctcaattctcctgaatgattgccatattcatttgtgctctgcctaccgaggcatttggaccagctttgttaaagtgtggtcactgaaagctctttgattcttctactcacctatcgttattatgctaaagaacaacattttgtgagtaagagaccactgaaaaacagagcaccagaaaggggagggaagcagagctaataaaaattatcttttttctcctcctagattgccaatgtatttcaccatgtttccatcctacagtgttttatactatgtatcagtaaaggcaaaaaaaggaaaattaagacttcagcaaaactttacactttgtaggcaagaaaaaaaggaagcaacactgagggatagaacataaatctttagacatatgatcagtagccatttctgaaaagtacacatttgggctgttttaaacaaatagcaaaaagcaattaggtctttctgactaaactgaggtgtatgctgatttctttttttaaactaagtctgttttgatcttcaaaaatgtcagactggtaaacactttacttttttgcacatataaatctaagagccaagcctagcttgaggaagatttaagagacataaaatttgtctgaggtgtctgccaaatctctacagcagagacagaaaccctggaaaagctgacacaatcataactctcacatcaccagcaggcttgtgcagggctgggaagcacagaaagtcactgttccttctctcatactgtttgtaaacagagaagcagatcatttgcttatcagctatctggtagctcatttttgcctagctatcccactgagaaaaaaaaaacaaaaaaacacacatccccacgggtacatatcccagttttcagctgggtgaattttcatttataagatgggcccgcttgttaaaattttctcttttatttgctcttgaattctcttactcttgtgtgcttgcttgctctctctctcccttgttctttctctttttatacagaaggcattaaaaggggtatttatgagtatctagtgcagtgcctaacggagtgctttcacatagtaagcctacaataattcatcgaatgaagtgaaaccctatctgtaatttctacattcaaattatttgatcatgtagcaggaaaactatagattttttttcctggagtatttaaaagtaacaattccttataaagaaatattttactcagatgactcatgcttaggacttccatcccttagaaatcatccatttttgcacaatgggtattatctgtaaggaaaatgaagggaagactacacttcaggatcctgaatgaccactgatacgttattgtagagaaaatcagatatcctatatacactcgactgtatgtcgtatggtaatccactacatatgtctaaaatcacttaacaatgcaagaatatagtgcacacatgggctgcgttctgtaagtaggattaactattgaattcaaccaaggtcttccctggggacagattgctggaaaatacatctacatgacatttaaaaaaataaattaaccaatgacatcggctcccatgagacacattgtttcttgtacattcaattctatcacggttttctgtagctctctgttgacatacccatcccaaatgacacagaatttcaaaaaataaagaaaaacagagcaactggagctattccatctctcctgtgtgaagtgttatgtacacaaaggaaagatttccgtacatgagcacaatgtgaaccacgacagggtgagatcatgtcagttggctgttcttgttatgctgtggtcacatataacttgcccaagggagtgtacaaagcctgttttcttcctgacaaggaccagcagggattgctggaaaataaagaaaacagagttatggcaggaggttttaaattttctctttaaaaaatgccctttattatgataacttttcttctcgctttgatgtatttagttttcctcatctgtaaaataggaataactattttatgtgtttaatatttttgctctgagaattaaataccagtagattgcctggcataaaatagctaatccatacagtccacatcaacattggctaacattaattaaatacctattatgtgcctgccactggccaaagaccccccaaaaaagtaaatcacagaaggaaaacctaatactagaggagcaagcagggagctgattttcaaagcttttatcaggcagtctaagaagtctggatattactctgaagacaatggacagcctttgaactattttatatagagaccagatggttttagatttgtgatttacaaaaatcattctgtcagcattggtaaagagtagactagaagggaagcaggctggaagcagcagtaatccaggctagaagtgatgcatgtgtgttggggggtggaaggtatgccccaaagtaagacaatggtggacaccgggaaaacattttaaaataactttttttttttttgagacagagtctcactctgtctcccaggctggagtgtagtggtgcaatcttggctcactgcaacctccgcctcctgggttgaagcaattctcctgcctcagcctcccgagtagctgggattacaggcgcatgccatcacgcccggctaatttttgtatttttagtagagacggggtttccccatggtggccagcctggtctcaaactcctgacctcaggtgatccgcctgccttggcctcccaaagtgctgggattacaggtgttaagccactgtgcctggtcaaaataactttttaaaaattaacaaatatactgtagattagaaaataaaaatacgcaaaaggttaaaagtagaagtcatatgcaatcttactacttgcagcaaacccctattaatatttttttgtgtgtttaccattacaggatttttcctatgtatgcctacacagatgtgtgtgtgcgtgtgcgtgtgtgtgtgcgtgtgtgtgtgtgtattatgtatatgtttttaaactgggatctgtcactctgtactgagagttctatgatgtgaattttctcttaatatatcaaaaacaattttccacatcattaaatattgtttggtaaaatcaacttacaaggctacttagtaatccattctataaatgtaccacaattgatttcattcaaatccctagtattgtacatttaagatgttcttttttttcttttttttttttttgttgtttttgctattagtataaacaactctgggatagatgtcctgagtattaaatttttggaaacatcatgattgtttcctcagcatagagctctagaagttgaagtggtaggttaaaagctgtattctattaaggtttctgatacatattgacgaattgctctccagaagagctgtatcaaattatagtcccagcagcagagtctatgagtaggagatgaacttgagagtgatgtcaaggacggagtgtactggacttgggtgggtagaaggaaggatgtttcctggcaaagtatcagggcaggaggaagatgaactctgtcaagagcagcaaagtaatgggcagggctaaggaataggtgcctggataggtaaatgataggaaagaaaaaggtaagataaccaggggagagtgaagaaaagagggaaaaagtaggtctttcatgaaattatgggcactttaatttactcctttcttcagcaaaagtagcaaatgtagcaaacagctagtcttttcatagcatttggcactctgtgctaccaaggtccccagttatattcatgcaaatctgtttatcaattcttttcacccaataaccatttattaggtgactaccatgtgtcaagtgctcttctggatgctatgggtatggagatgaatgaaacctggtccctgccctcaaggagttcacagtctagtggggaacacagagacatccacagaccgacaccctacagtgtggtacaggctaggacggaggtaactaagtgcagggtcctgtggaagcccgaggcctaacattgccttgtgcgtgcattcatgtatgttgggcaagggctgtcgggaaggcttcacagaggtgttgacatatgagctgagtcttaaaggctgaggaatttcttgcatgcctaagggtcacagatcatggtcatattcctaatcagtgccttgaatatttgtgctactgctctcaaggacactgagtaaggtgggaaggatgtttgtgtgtaatccaaatccactcgagtggtaactatagcttccattgtaatcttaatgaacatagaaacatagcatgttttggcaatattattgctcaccatacaatataaaggacaagaggcaaggggggcatgcagacttttaaaacaattctggtaacactgacaaaataatattaacatccaccaagtcctaataattttacctcctaaatgtttctcaaatctcttcgctccgctcacgtcactactcttgggtctttattgtctctctgtggaacagagtagcagcctcatcatatccacctccactgtatccttcccactgtcattttccttacagtaaaaatctgatcgtggtgctcttctaaaacatgttaatggtttcttatggcctacaagcagcacttcccaaatttcagtctgagtattacttagtgatttttaccatattcacacacaatgtgtactattactacttaatatttgtctttaaatgaactgaaaactggttcactttctatttttatgaagtaaaatccaaagtaatcttagatgtgatggcttagttcagttttatgttttttaagacatatttgaacatgtaactagtaaaattaaaatgtttgtgggagcacagtgtaactaccactggcagatgccctacgttttgagaaccactgacctatgggggcacattccaacttaggattgcaatcaaggttctttgcaaatcagccccaacctctttccagactcttctcctacccattacagtttccttttactcaactatctgcactccaaccatgctgaattcttccacattgaatgaacatgccctactcttatacagccacacatctttcacagactgactcctctatctgaaatgcctcccctccactccttccctgcctggggcaaactcactatccttcaagacctatctcatgtcacctcctcatggaagccttctccccgagtctcccttacagtgagtcacaccttcctttatccctccatagcattttgtacctgtctctgttatactacacactacagtatctcagaactgtgggcatccagctccccagctagaccccaggaagagttcacaccttgtacttcattgtttctccaacacttcacgtgggcagaggtcatgaaagagatctagtgtcccaggtaacttcttaaaatgctaaaataaaatacatccaaagtgctatcaaggtccaaatagcttagaggtatgatatgtgttataaagagaatcatctaattcagaaatagccgtactgactatggttttggcagacacaattagctacagttgcaatgacagttaatttggttttggcagctactttacagcaaatacattctgacatagaaattttaagtgaatcatttgggttttggccaggatgatgaactatacctatctctccttaccacaactggaaagtcaagaacaagaaagaacattgggagcagcaaaccatgttgaacagagcatgggctttggagtcagaaatctgtacacccaaacctcaactcaacttataatctatgtgactttaagtagattgtttaacttctgtgcattttagtgttttcttctagaaaaagaaacaggaataatagtacctacttcataacactcaagataatgcaacaaagtatttatgatgatgactaggacattatgtgggttcaataaatagcagtcattattgtcacccaatgagatgactacagttcagataatgtgatgcacggggacagcaaatgcatttcttaagaaaatatatcgatgtctctaggctttaaagttgacagctatagactgtagctaagaatagctacaaacaaaacatctgcaagacaagcttcttcttggatttaaactcacacctggaacataccatcacacttctttgtgttctccaagaattgatctcaaatcaggttccctaggatgaaaagaaaaatcatccaatcttaatttttgccttcaattttatttgatacagaataatatccaaactatgtgtatgtttcaaagtatcatgttattatgaccccaagcttctccaccctatttatttcccagtatatttgtgctgatatcttttattccaatcaggcaagcccacctgtctcacagtgctccctcttctgtttacccttctcaaagtccaatctcagtagcaggaagcattttctccctcctctttgacaacttcaaatcccctgtactctgctggagcccagattaaaattcacctccttcacaaagcctgaaagccggatgagggcttcagcacttcccgggttaggcttgaacttccatagatgaactcaccacccccatcagtatgctcttccactgacccctcttagcgttttttgcacacgtttgtaataatacaatgattaatatggtctgtttcacacggtctactttattctgtagaataaaggtgtgccccctaaatgtttgtcaacattagtgctatcagtctttgctggaaacccctaaagcgctggatttttataaccagtctaacttgccttttactctcaccagaaccctgcactgaaccttaaacacacatttctcaaaagcaagattccttccctcttttgcttcccatcccttctagaaattgaggggaaactctccccacttcaaagacctggtgggggaagtggcaggtggctgaggggccagtaaagagatggcgatcaattaaggaggcaaaaagagaaagtttgaaaaaaaaaagtcacgccctgagcgtggcaaggaattcccatgccccaaagaaaatggggagtgtagcgcagggagggttatgtgcccaaacctgaaatacaaattgagggaaaagaggaaagagatcacccaattcctgcggtaagaattagagtccagtcaccgcctaggcaaaaccctggacgcaaaccccaacttcggacctctgaggaggcacagagccagggggaggggggcggcgtcgtgggaaaaaaaaaaaggggcgggcgagttggaccaaaaaaaaaaaaaaaaaagagcaaagacagcgcgctcccgggctcaagagaactggcgcctagagctcaaaagcccacccccgactcccagtcccgataccccctcccctgcagaggtggagctgggtggagttaggcgctgaggaccgcggccccggaagcaccctcctccctaggccccctcagtcccacagtccccagccacggccaccggggctttctgcctctctgacctccagctccccggctaccgaagcgctagtccttatacagccgcggaaaatcgggccggcgcggcagttcctgggctcgtagtgccctcgcggcgccccacgccgcgccactctcttccgaaatgcccgcctcgcgcttccaggcctagacccggcactctggcccaaggctggactctcacacacagggtgcccactgcggcgtctcctattggctactggtcaccggggaagccggaggcccgagcccatggcttcatgggaaatgtagtttgaggtcgctggaggctgttcttcctgggggtaactcgtgttgacattggcagacagacacaagtgaggaccgagaattatgggagatggagttgcgggacacttatttctctatacgcacaattcttcccctccccttccgattgtccccagcgttcagacggggaagggtattctgggtattgtagtttgggtgcactgtctagagaatctctcttggggttatgggtttgtgcttgtggggacagacgaaggctctagatttattttcatgtcggttaagctcttagcattttgcgggaagcactttctatcgtgatttgaaattgttattgagttttaagtgtttttcaaaagatgatgtttattctttggtaagcttagaattttaattgagagttatagtcctttaaaattgttaaagtgtgttccttgtgaaccacctgcattaaaatcacttgaaaggtatggaagaatgtatatatttttttctaattggaaattatagttccccctggaaacagtgtcataaataggcatagaaatgtgatctacaccagcccagaagaagcctatttaatccataatgaagctatgttgttgccatgaaaaacagtggccacataaactgctataaataacaatttagaacagatagacaatacaacttaagtacaaacgagtaactatatgtgtctttaagaaacttaaccttttgagtaaaaatatgttacaagagctggataaagacataggtggggaatgccaagcacttccaagtgacttaaaggttgaggaaaatggttgtttattagggctaatttcactcccaacttttgacctttttttttctctgttagagatgaatccttgtagccttgttacagttgaattactacaacttcttgatgaggacaacttttcgactcacgagtaaaatgaagggaaagacaggggaattgcattttgctgaggtaattgcccaatattttaaaaagataagtgaaggaggaagacgatttaataaattcaaccatttattcagcatagtgctttgtgcaaagctctgggctaggcactgttgccacagaattggaaaaatagtccctaccctcaagtagctcaaaatccaggtgaggggagttgtagtagaggagaatctggggggaggaatagatgagtatacaatgtgcaaaatgctgtaaagaagtctacatagggttctataggaacatagaggaggaagaacttgttctacttctggagaactggttgaagaaccagtaaaatatttgtcagatttggggcagggaggtcaaccatattctatacaaagcatatgcaaaggcataaaggcatgaaagagtgcagagaacaatagcaaaagttccatattgcagagactagatcaggcagcaacaaggggtcatatcaattagttcataatttaacttgaaagtgggagagaaccatcagaggaatttttgtgcttatatagtgtttattttttaaagcatatacacatagaacatactgggaacacatagctagggtattatggggaatcattctggagggtggtaattgaattgctatattatgttttaatactttttatacttttaaattcctccaggaaaataatttgcttttttaaaaaaagaaaaatcggctgggtgccggggctcatgcctgtaaccctagcactttgggacaccaagttgggaggattgcttgagcccaggagttcgagaccagcttgggcaacataatgagaccttgtctctacaaaaaatcaagaaaattagccaggcatagtggcgcatgcctgtagtcccagctactcaggaagctgaagcaggaggatcccttgagcttggaaagttagggctgcagtcagccgatattgtaccactacactcgagtgtagtgggtgatagagcaagactctgtctcaaaaaaaattaaaaaattaaaaaaagaaagaaaaaagagaaaaagaaaaatcacctcatttcagccataaaaaggagtgaaacaaggcattttcagtattatggccaccagaaaaacattgtgtgaatcaaatgcagaatttcttttctcagctttgtctcctttctttttatctttttttccatgactctttactttgatttgatcattgatttcaaagtatttgcagagcacctactatgttccatacactatgacaggttttgggttttaatggtgagttaaaacatgggttcctgttcatcaaagtatttctagcaggaaatggaataatcagatggagttggtagatgtggaaagtgagagacggggaggagtccattacgactcccaagttctgacttggaagactaagtgtatggtagtaccattcactgagatattgaacctagaaagaatagcaagttttgtgaagaataggaggaaatcagttttgaacatttaaaatttgaagagtctgtggaacttttggttggagatgcctgataggctgctgagaaatgccggtcggaagcttgggagagaggtcttgcttggaactaaacatttgggagacattagtataatatagagggcaattaaataagtgaaaaattgtttaaactttacttagagagtatttttttttttgagacggtttcttaccctgttgcctaggctggagtgcagtggcacaatctcggctcactgcaacctctgcctcctgggttcaagtgattctcctgcctcagcctcccgagtagctgggattacaggtgcctgccaccacagctggctatttttttttttatttttagtagagatggggcttcactgtgttgcccaggctggtctcgaactcctgacgtcaagtgatccacccgcctcagcctcccaaagtgctgggattacaggcgtgagccactgtgcccagccaatttagagagtatttagaataatagtttttaaaaagacaaagattatggaatcctggaaaataatgatattcaagtagcaagtagaagaagagatgccttccaaggaagctgagagggaatgcccaaacagatgaaccaagagaaaacaaagtagaattactggcatatattacagagaggtcaagtagcaggacagaatagtaagaagaaattactccttcatcaatataacaagtttttattgagtacctataatgtgccagacattattctagatgctgggaatagagaagtggaaaacacatacaacatcccttccctttggaggctatattctgttaggaagaagccatcaacaaacaagataaataattaaaatacatagctgtgataagtaatatttcttactgtgtatgtcacagctgtgtatggctatttctgtatggtgatataaatacacacacacacacatatatatatctccaataagccatatggaaattttatatataatatataaaacatatctatatctccaataagccatacagaaattttatatataatatatattatatataagcacaaatgtatacatatatttgtatgtgtatatacaaacgtgatactctttggtctgttgttatataataagatgaatttgtgaaatactggcccagggtcaaacagtctggctggattcagagaacaattaggaagtcaaggttagagctgtatccagagccagtgtagagcccaggtcaaggccagggttcatgtgtataatgtggaatgtatttagcttcaatcttttctcaggttaagatttagtaagtctgtagctgtttttacaggccattgtggattcaggatcagaagaccatcaaaccaagcttagggttaagcctgatagcaatattaggccccagatttagagccatggttcagtctgtgtcacagattaaagtgcatttctgaccactctggactaacagcagcctcagggtgttaaagctcactctgaggctgctgtaagtctagagtggcctggtttatgaagtcaaggtgcaagatttgggttcaaattttggccagaattaggatttagtctgtgtgtaggaagaggcctcattctaaaattagagttagggctcagtctgtggaccagacttagaccacacccaaggttagggctcagctcaatgtttgactttagtttttgatcaatgttggaatcactttcatttctagacttgaaagtcaataaaggccaggaccatggctctgcctgggattagtcttcatgctgatgatgttgcctaggaaaaaatgaagtaagaatatgaacaggatttatgttcagtctttcttcaggttaagtttcaattcgtattcatggttagagtttattctgggtccaataattaagtctcagtccgtggccaatggtaaggcacagtcaatgtctaatattcagtctgttgccatgttaggacattacctgtcatgtgccctagagccttgtctcaaaccagagttagcatttcatatatggacaaaattatgatacagtttgtggccaggatttcaatgatgaatatgaacaggatttgggatgcatatttggctagagtaagttcaaggtgtggtttctgactttagccagtgtcaggattctgtctttgtccatagctcatatcaacaatgttctatggagctaactcacagtggcctgtgttggccctcattctgtggccagagcagggctcagtcggtgacctgtattagccatttcaatttgaccactatcagagttgagtctggagggagtaattccactatgactttatgtagcatttgtgttcactgagtattggtggtagtgctatctgattaaacttgtaccagagtttgggagttaccaataaccaaggtaaggcttactatgaagaaggttttaaggctaagagtgtaaacaggttttttggattagctgttgatgttatttgtcagtcagtggatagagttgagatgagaacaaacaacacataaaatccagattgaaagctttagaggctcaggctgtaatcagggttttgggatcaggatgttgccagggtttgagttcagagtgttcattgcctgttgtcagtctggcacttagactctggcttagtgtagcaggcatttcggtatcagtagtagagttcagtctttgctaattgttagtgaccataatgtgcccagtgccatgggtacatctattcacaattgaggactaagtttgtgaccagactgattgctcaacctccagctagtgctaggactcagtttgtggccactaatacagtgaactttgtttatgggtttaagacttgatatgtgacaaaggtgagtacttagtctcagcctgttgttagatctgataatatgagcaggattttgatttagtcttgtagggtcaggaatcatttctctaaccaggcttagggcttggcctttaggtctcagactgtggtgggacttacagtcttcatcccagctcagtattcagaatgtggccaggaagagggctcagatcttagccatggtgagttccgtctgtgctcagggttagaattaaatctgttgcagggttttaggccaagaaaatgaaaagtatttgttttgtctttgtctagtttgtccttcattcatcttcaaggtttgggttcagtctctgcccagtgctggtgagcagcttaatttctggtattaggaatcagtcggtagccagggttaaagttaaagttgtggttgaaattgggatccagtctcgggtgaacatttagccagagatagggttcagtctatctcaaaaattcaggatcagtcattagccatttggagaaatcagatttattttcaggttgaaagctcatgtcagaggttaggcttatgggctcagtctgtgatgagagttaggaattcagtctatggctagagttagagatgcagtctgtaaccagttagaagctgtaaggtttaggggtcaaatcagtggccagtgatagggctcagtctgtcccaggatcagtagattatttcctgatcagatttatgaacccagtctctgtccaggtttagaacttgggctttgaacatggttaagactcagtttgtggccatgttcagggttctgtctatagtcaggattaggacatatgctgtggtcaaaatattctcaagttttgtggaagatttggtttcacttcttggccatgattaaggcacagagttgggacaagtttagagtctggtctctgtacatgttttcgtctctgtatgaggccaagtttagtagtcattctgttgccaatgttggggtcattttctggttagtgctaagtctgggaaattgtagctgggttggtttccaagatcagatctcaggctgtgaccaagttagagcctcagtctgtagtcagggctagagctcagttagtatctatgctgagcactcattttgtggtcagttcaggatgttaagtatatcccagagttaggtcatgcagtctgtagcctagtttagagactcagcctggggacagacttaggggctatatctgatgttatttttgatccctgtatcgtgaattaaggacttatacagtagccatagttatggttcaataggggatcagggttagagattcaggttgggaccagtcttaagtacttactcttgggccagatgtagacagtcagtatgtaactaggcctagggacttgatttaatcaggattaagaccttggagtgtggccagaaagtggctcagtttgtggatagaattagggtcttcatttgtggccagggttaaaggcttggtgtgaaattggagttaagcctccaagttcagagttaggagtttaggctatgtcttgggttaggtgtttggctggtggtcagggttaaacacaggatctgcattcagtgttggcagcttgctctgtgaccaagcttaagagactgtttgctcagcctgtggtgatagtgattggtaattatacatcaataaagttgtcataaaaggttaaaaaagtggattcatacaagtgaaatggtaggaatgatgcagggaagaaaccataaagagaggccgtttactgaatcaggaccagcaatgtccttggtgtctcagaatttttgcttaagaaggacagggcaagcacatgagattgagaagaaaggaaagaactggtgaccagggagctggtaaccctgggaagtagatatgtgcttcttgaaggacagacatttttataaattgtggaattaatgcaagttggaaaaccttgcaaaaaatggaaagtcccatttggttttttgtttgtttgttttgttttgtttgttttttggggatttttttgagacggagtttcgttcttgttgcccaggctggtgtgcaatggcgcggtcttggctcactgcaacgtctgcctcctgagttcaagtgattctcctgcctcagcctcccaagtaactgggattacaggcacccacccccacgcccagctaatttttttgtattttcagcagagacgggcttcaccatgttggccaggctggtctcaaacttctgacctcaggtgttccacccgccttggcctcccaaagtgttgggattacaggcatgaaccaccacacccggccagaaagtcccatttgttaagctcttacatcatgttctttttgccagtattggttttcctgagcaccctttctaaaccattcctcatcttgccccaggctacactgatctccattatatctcactcactatatgttcaataaatatctatggaatgcatgtttgtttttacttacattctcccatggaggctcatgacagtccaatatgataagtgttgttatcctcattatacagattttaaaaagctgttaagctaattaagagattcaaaagagccacacagctagtaaatgcagagccaggtttcaaatccagttttatctgaccccagtctactgtgctttttgcatatgccacctggcccatataacatatgtgagatttacatctcaccttgaccccttgactttgtcaactttgtcttaattcttacagcaactctaatttttcatctggaaaattgggatgagaataatattaatacccatttcttttctttttcttttctttttttttttcagagatagcgtctcactctgtcgcccaggctggaatgcagtggcgcagtcttggctcactgcaacctccgcctcctgggttctagcaattctcctgcctcagcctctcaagtagctggaactacaggtgcatgccaccatgcctggctaatttttttttttattgtagtagagacagggtttcaccacattgcccagtctggtctcgaactcctgagctcaggcgatcctcctgcctcggcctcccaaagtgctaggattataggtgtgagccactgcgcccggccaatagtacccatttcataagattgttatgacaattaaatgagccaatacattgaaagaacttggattcatcaggttcatattatgatgatgccctttttggagttgaaaaaacatgttcagagagtttattttctcaatatcacacagctagtaggtagcagagtgaagagtagaatccagatgggtccaactctcagttgaaggcttttgctggtttctcaggctgcttctgaatacctcagcctccaggaatggcttttgatggacattttgggcttcggtgcagagtgacacagggaaggatttagtgggaagaatatgttagttttccactgtgtcattccctacagtgatttgaacctgtgaggaactgagagagtgtacagaagggggcatatcatcatctctgtgagggtacatgtagcttctagggcaccctctccatgagaatcactgagtgtaaaatgtaagttcgtgatagtgtgttgtgtgtgtgaagagtatgggggcagcaaaaaggtggatgaccactgaggtaggcctccatgcttttctctatgcccaaatatcagccttgccaacagtatttccaagggactgtacagccaactttccattatttctaccgtctgctcttggcttggcttggcttatctacattgtatctggcatctacgtctttccccagggagtctatatgctgtggacaagagggattgattatgttcctgccttcagtatggctaaacaagctcctgctgggcctgtgggacactattaagcagaccaacgttgtcataaatggaaactccagcaggataagagagagagaaaggggcacaaagaatatctgaatgaccaaaaatatcccaaacctgatggaatatgtgaatctacatatctgagaactcaacaaaatccaaatagacaaactcaaagagacctattttctgatgctatggttgacgcacattctttggctatagtatagcacctattctctagttaaaatcttgtgcataatctcagtacatggaaagagcaaatcagagtgctctattccagtcctttacttcctgatgcgactcatggtcaaaacttgaccctggtatatgcaaagctcaaatcccaagatcatgttttctgcatctatagtagatacaactttgctttacgtgatccataaccttccactcaaagtgataggcacttttgggacttcgggctggaagacgggtataatctctggctggagaaaagtgaagactgggccaccaattcacaaccaaggaggcttcatcaggatctcattagtgggtctcaactatttttctttgctttcattcttgagctaccagaccatgggccatgacccattatctataaatccaataatctcaaaaaccgaaagttttcataagtttaccaccaaaactcattaggtagcaaaatgtgacctgaatcaacataaggctacttacagtcttcaacctatttctatgaatattcattttgatatagaaatactaatgtgtttgtaacacctaccaggggtattatagaccatgtatatataccatattacctttctaaaatctctcaaataatgaatttcagaaaacatcggcccctaagtgttttgtatgaggaattttggatatgtatttcctctccttgctgtctcattctaatgtcacgttcctcactttatcccatacctggcaacatctgccaaggccagggaatgggaacactgaatgcttttgcagtaaaacttcatatcataaaataaataatgatgagttgaattagtatgacagaggaggaagtgctaagaaaaatatcttcatgtttttcctccatcgtaggttcagatccaaaaacatattctcccataccatattgacaaactctccaaggttctccacctaaagacccatttgtaatccagctgaaaacagacaggggttggatgctaacctcaaaacctgattactgctgctgctgctactactactactactactactactactactactattacttgtactactatactaacattgagtacaacttgccaacttcttgttctagagcttagaatccaagctctttcaatatattggctcgtgtaatcgtcataacaatcttatgaaatggatactattataattaccatcgaaattttacaaatgaaaaaaacggaagcaagagagatgaagtcatgtattcaaatccatacagctaagaattagccaggcaaggattttgatgtacctcgtacttcctttgcatcttcactttattttgaaattgacttatggcataacctaatggacttatagacagggggagaagtatgatgggctatgggtctggggagccaatcacccatcctcacctgccaggatccaatgaggctaaggtgttttcatacacatttttttctatggagtctggaatgtggaattcattatgcaaatttcttgatgtgatgatttggctggaaaagcaggtactatggaaaagttcccccacttatctctaaggactactctgatgtaaaatattatgtgttgatgagtatgttttttatttgcatgcatgggcatacatttacatgcatgattctgtgtcagtcagcatgtatgtgttaagtatagtacattggttctcaagctttagtctaatctcagatacctgggtaaaatcacaaatactcctgggtcctatgctcagagattctgattcagttcagttggggtgggacacaacagcttgttacttgcacctgaagtgattctaatacaggtggtctgtgcagactacattttaagaacaatgggatcatgctttagagtaggctctggagccaggctgctagtgagtggtttaattttaggtttaagcaagtcaactgggctctgttaatatcagtttactcatttttgaaaatgaataataatatacctacttcatgaggttgctgtgaggattaaatgacatacacttatttaaagggtatctcatttgatgtgcctaacccatcataagtgatcagtgaatagtagctacactattcacatagaccacaaggataatggcaaacataatggtgctccccattcctacccccgtcccagaattatgcagtgcagatgccctgagggcatgctagggaatagtgaagtggtgtgaagaggccaactcctgaggggctgcaaggaccaggaattttggttgtaacccacagcctcactccttgaaaaggatttaaagaacatagaaagcaaaatggtgaaagggtttgcagatggtaggtttgggagtgctcagcccacttcaggtctttagggcaactggtcctgcaccactgtgttcacaatctggcccccagctggcatttaggactggaagaacaatggaccctgtattcagggaaaacttgaggcggagtgctgctcattggtcttctaccattaagatgctatataaagagaaatactaatcaagtagaaatcatggtgcctgacctcaaggagcctagagtctttggaagaaacaaacatgccagcattgttactttaagcaattcccatccactctctgggttgaagctttgtctgtaaaatgatggtttgtacttaaaactttgaacatgttacatttctcatccttctagaaataaacaagcattaagtcacagaaaggagtgcatgatgatgacacagtgtggtagagtgaggcaatatcactccagccagcttgcaaagctgctgtagagtgcaatggctagagctactgccaggaaggaagaggggtaatgggattgggtcaaaggccttagctctcttgttggtgccaaaaattgctcactttgatacctaccttgagccagatatacaacagatatgccacatgttggctcttgctgatactcctctagcccccttgctgctcactgattttagctgaaagtggggattaattgacaaggacatcttggaggaggatgtcacagatcctgtagtgtgccagaatgaattcaggattaagtaggaaactggagactgaagtgactgagagccaggacagggttagcctcctaaaacaccctgtctggagggcttcactgtggctaagggctgctaatatgagaagtgtatactacagctataaaattaaagatagcacttactacatgctaggtgctgttccaagcgctttacaaggaataactcttttttgccttattataaccttattatgatagcaattattattattttcttttaaagttgtggaaactgaagcgtattaagcactctccagccaccaatttttctcagaggtttttgttttgtttgtttgtttgtttgagacagagtctcactctgttgcccaggctggtgtgcagtggcgcgatctcagctcactgtaacctctgcctccagggttcaagcaattctcctgcctcaccctctcgcgtagctgggattacaggcgcctgccacgagatgcctatttttagtagagacgaggtttcaccacgttggccaggctggtctcgaactcctgacctcaggtgatccacctgtcttggcctcccaaaatgctgggattacagacgtgagccactgcacctggccagagttttttttttttttttcttgtcttcattctttccctgtaccctgaaactcaccttgatctgccttgcctgggaataacattttattccaataatgttctatatataatgttctatataattctggagtcaaggtaccttggaaatctagccaaccatagctaactaatctttctttctgcccctatcagcctcatagacatgtcctcagtgggacatcttccaggaagtaccaaggagtggctttggggaaatagggagagatggttagaagagcaactcttcccgagcaaaaagaattaagaggacttatacagccttttgaaagtgtggcaatgggatactttgtcttagagaagagcttcctggcccaagtgctggaaaggaaggatgagggaaggtggaaacacacggatgaaagtatgggcagggctgtaaccttagtcaatgggctaggatggcccatgcacggtggtttggggtagaccttaaataaaaaataaaaactcttctcccataacaaagtcttgtttggttgtccaggaagccccccacagaattcaaacgcctctgggaagtttggtgcagagcttatgggcttttcgcattctctggtgccacctggtggacaacaagaggtaatgagatgggatctaggaaattgggcagttcagtttggaagggaggagaggggaagtgaagctggaccagatgattagtgctgtagtgggcaggcactgaggggacccagtgcacccacaggaaaattgggttcctggtgaggctgatggagtcaaagagtgtagaccgttagagataatatatgtaaagaccctgatctacaggccaactgtaacagcatcaaaaggtagtgtttactacttaccacatgccagactgtgttattaactttttcatgaattttttaaaatttaattcttccagccacactttgtagcatccccattttgcagataagttaaagtgaggctcagcgttagtggcagagacaatgttcaaggttttaatcattatgccataaattgtagttgttgccaatattgtgatatgatgtgaaattagagatatgaaggaggatccttaagtacttcaaatctgagtcaagtaggctttgatgccagtgggagaaaagggaaggagaagtgtcatatacaccaccatctctaccttatccaccttcaaatatggggaaacaaaacaaaagcaatctagaattcacctacccactgtctcagccagtaagcacattttaggcacctattctatccagagctttgtgggacaaaatggcatttgcccccaggagtcctgatatgccagcattactcgtttctccccacccctatctccaggtcttctaaagtcctcaggtggggagcatgttggtgagtctttcagaaaacactgtcccatagggaataaaagacaaaaaataaattccatctatatgttgattgaggaattaggaaatgtcttggtttaaaaaaaataggagaagcaaaagaaatcagaaaacattgagcacctgctatatgttagctaggccctatgctgagtgcttgacaacagaattttatctaatccttccaacttctgtgaggcaggtctctaaatattgccgtttgaaagtgaggataactgaggatcagggaggttaggcaacctctctatagtcacacagctaatcagtaggggaactctgtatggccgcaaaacctatgctgttttagaatgaagggaggagggtatttatttttcctttttattgtggaaaagttcaatcaaatgaaaaatagaagtaatagtataatgaagtcccttttacccattacctagtttcaattacagttagcacatactcaatcttatttcatctgttctcccattcaccccctcccacaaaactggattattataagtaaattccacacatcattttattttatccacaacattttcaggctgcatctctaaaagatatggacttttaacaaaacatgactaaaatactgttatcacagctgtaaaattaatactaattctttcatatgatcaaatatatattttgtgtttaaattcctcctatcatctcatgtcttttctcattatattagtccattttcacactgctgataaagacatacccaagactgggaaatttacaaaagaaaaaggtttaattggacttacatttccacgtggctggggaagcctcacaatcatggaggaaggcaagaaggagcaagtcatgtctcatatggatagcaacaggcaaagagagagagagcttgtacaggggaactcctctttttaaaaccatcagatctcatgagacttactatcacgagaacagcacaggaaagacttgctcccatgattcaattacctcccagtgggtccttcccacaacatatggaaattcaagatgagatttgggtggggacagagccaaaccatgtcattccaccccttgccccttccaaatctcacatcctcacattttaaaatcaatcatgccttcccaacagtcccccaaagtcttaactcatttcagcattaactcaaaagtccacagtccaaagtctcatctgagacaaggcaagtcccttctgccatgagcctgtaaaatcaaaagcaggttagttacttcctagatacagtgggggtacagacattaggtaaatacaaccattccaaatgggagaaattggccaaaacaaaggggctacaggtgccatgcaagtccaaaatccaacagggcagtcaaatcttaaagctccaaaatgatctcctttgactccatgtctcacgtccagttcacgctgatgcaagaggtgggttcccatggtcttgggcaactctgcctctgtggctttgcagggtacagcctccctcccggctgctttgatggactggcattgagtgtctgcagcttttccaggctcacggtgcaagctgtcagtggatctaccattcccgggtctggaggatgatggccctcttcttacagctccactagacagtgccccagtagggactctgtgtgcagactccaacgccacatttcccttctgcactgctctagcagaggttctccatgagagccctgcccctgcaacaaatttctgcctggacatccaagcatttccatacatcttctgaaatctaggtggaggttcccaaacctctgttcttgacttctgtgcactggcaggctcaacacccatggaagctgccaaggttgaagcttgcaccctctaaagccacggcctgagctctacattggcccctttcagccatggctggagtggctgggatgcaaggcaccaagtccctaggctgcacacagtacagaaccctgggcctggcccacaaaaccactttttcctcctcagcttcaggcctgtgatgggaggggctgccatgaagacctctgtcatgccctggaggcattttcccccttgtcttggggatttgcattagttatgcaaatttatgcagctggcttgaatttctcagaaaatgggattttcttttctatctcattgtcaggctgcaaattttccaaacttttatgctctacttcccttataaaactgaatgtttttaacagcatccaagtcacatcttgaatgctttgctgcttggaaatttatttcactagataccctgaatcatctctctcaagttcaaagttgcacaaatctctagggcaggggcaaaatgctgccagtctctttgctaaaatgtagcaagaattacctttgcttcagttccaaacaagttcctcatctccatctgagaccacctgagcctggaccttattgttcatatcactatcagcatttttgtcaaagccattcaacaagcctctaggaggttccaaactttatcacattttcatgtcttcttctgagccctccaaactgttccagcttctgcctattacccagtttcaaagttgcttccacatttttgggtatcttttcagtagcaccccactctactggtacaatttactgtattagtcctttttcatgctgccaataaagacatacccgaggctgggcattttacaaaagaaagaggattaattggacttacagttccatgtggctggggaagcctcacaatcatggaggaaggcaaggaggagaaagtcacgtcttacatggatggcagcaggcaaagagagagagctttggcaggagaactcctctttttaaaaccatcagatcttgtgagacttattcagcatcatgagaacagcatgggaaagacttgcccccatgattcaattacctttcactgggtccctcccacaacacatggaaattcaagatgagatttgggtggaaacacagccaaaccatatcactcatatttctgattctttcttgttattgagatgtaacatatatggtaaaatgtaccaatctcatgtacaccttgacaaatttttatcggatgtatgtctgtataactaaagtatattccaaagtggctgcaccaaatttattctcttgccagcaatgtatcaaaagttaagttacttcacatccacagcaacagtatggtcagtactttaaattttagccattctgattggtgggggagaagggtaggttagctgtacctctttgtagccttatatttatccagtgaataatgatgggtgcatcatttggatgtccattttgtatgcctgttattttaaaactttgtcaatctattcttactgatatataaaagtttattatatatgttctgaatatgtatcagcatatatacagatcttcttccagtctgtgtctggcccttttcctctttatttttatcttgtcttttgattaaaagatattcttagctttaatgaagctcaatttatcgctttttttggctatttttttctgtccatttaagaaagttttgcttccctgaatataatgaaaatattcttctacttttcttctagaattaattaatgtttgtgtatgatgtgagttagaggtcaaggttaattattccttatgagtattcactttacccagaattatcttttcaccactgagtagtagtgatgattctgtcatgaagcaagttactgtatgtgtagatttgtttcctagctgtctgttttattccacttgcctgtttatggttttatcaataccacactgcttaattactatagctttataataattattgctatctagtagtataagtacttaagcttgatagtgttggaggatagtgttaggatagtgttggaggtggtggttcttcctttgcttctccttctctcgatacctccccttccttcctcttcctcctttttctcttcctccttaattttcttggctattctaagtttgttgatttttcatacatgattttacattgccttatcaattttttgaaagctgctgagattttgaatagtattttcatgagtgcatacatcaaatttggaagaattgacatctttaatgatattaagtcttccttccatgaacctggcatattaaatttatttaggtcttcttcagtttccttggcagtattttgtagttttcactgtacagatcttataaaaaattttgtaaaatttatccctaattgttttctctgtttacatgctgttgtaaatagaattatcttcttaacatcatttttcatttttttcattgctactatacagaaatataattgatatttgtatattgccctattgtccagtgaccttgctaaattcacctattagttctagtagctttttggtaggttccttgaaattttctgtgagcataatcatgttgtttgcaaataaacagttttaatttattccttttgaatctgtattccttttatctcttcttcttgccttatggtgctgactaggactcccagtacaatgttgaataaaagtggtgggagtggacatcattgccttgttgctgatattaggggggaagtattcgatctttcaccattgactatgatgctagttttaggtttcatgtaatgtccttgatatagtttggctgtgtccccaccaaaactcatcttgaattgcagttcccataatctccatgtgtcatgggagggaccggttgggaggtaattgaatcattggggcagcttccctcttgctattctcatgacagtgagtaagttctcgtgagatctgatcgttttataaggggcttcccccttcgctaggctctcattcttctctctcctgctgctttgtgaagaaggacatgtctgcttcctcttccaccgtgattgtaagttttctgaggcctccccagccctgaggaattgtgagtcaattaaacctctttcctttgtaaattacccagtctcaggtttgttcttatagcagcatgagaacggactaatacagtcctcaatcaggttgaagaagttgtattctattcctaattgctgagatatgaatgctgaattttatcaagtgtgttttctgcaaatgctgagatcatcatatagatgttctcctttattccattaatatggcaaattgcattgattttcaaatgttaaagaatcttttattaatgggacaaaccctactttgtcataatatgttatactttatatatattgttactaaagtactaaattctgactttaaaaattttttcaattgtacataaactaacttacttactttctctctctctctctctctctctctctctctctctcttttgagacagggtcttgctctgtcacccatgctggagtgcagtggtgtgatcatggctcactgtgcagcctcaacctccacaggttcaggtaatcctcccacctcaacaccccgagtagctgggactataggcatatgccaccatgcctggctaatttttgtattttttgtagaggtggggtttcaccatgttgcccatgctgtcttgaactcctgagctcaagtgatccgcctgcctcagcctcccaaagtgctgtgaatatgggtgtgagcctttagtaaaaagacaaagactttcaaattagattttaaaaacacaactctgtgctccttaaaagagaccctttgcctaaagcatgcaggaaagtcaaatataaaatagtggaaaaaggtgtctggcctgtacataagctttctattgcaatgttttctgtccttgttatcatttcctttcttatattttctttaggttaatttgttttactagctttttgagcaggaagattagatcgttgatgttcaacttttttcattttagttcatgcatttaaaactttaatcttcctactgaaaactgatctagctgaatcttacactttgatagtttatgtcaaaatagattattcaattcaaaatattttcagctttccactgtatttttttgacctatcaattatttataaggtattgcttcattttcaaacaattgaaggtttggggatatttatttaatattggtttctagttaattttcattttggttacagagcctctcctatattacttcagtcttaacaatttgttgaaacttgcttcatcactcaacatatggtcttttttgggaaatgttctgtgagctctcgaatatagtgtgttttctgctatttttgcaaatggtattctatgtatgtcgattaggtcgacttcatctgttgtgttgtttatatctttatataagtactgactttctgcattttctgatttactttgagaaatgtgttaatttttcatactacagttgtagatttgtctatttctgctttgttacatgaacttatgtgttatgtatttaaaaatgtgaaatttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaatgtgaaattgtgtgcacaaacatttatgatttttacatctccctgttgaggttgtattatgcccctacgaactagtgatttttgtatcttccatttaattctttcttaatctttgaattctgttgttgaattcctttgccattatgaaatatccttctttccgtaagtatactttgagtcataataatatagctatatcaactttcttctagttattgcttacatggtgtgtatcttttcccgctcttttatatttgactttcttccatgctttaggcaaagtgtctcttttaaagagcacagagttgtgtttttaaaatctaacttgaaaatctttgtctttttactaaattgcttattccatttgcatttctaaatgtgttgactataacttatatataataaagtgcacaagtcttaagtgtgcagcttcatgaatgtttatacatgtaaacacctcgtaaccatggccggaccaagatatagaatattttcagcatctagcaggctcattttgccccttcccagttatcctcatagaagactactattctgacttctatcatcataaattagttttgtcaatttttagtgtaatactcacggaatgacacagtatgtactctttagttctacttctttcattcaatatatttcagttagattcatcaatgttgttgcgtgtgctagtagtctatttttaatttttgtgtagtattccattatatgaatttaacatttattccatctactgttaatggaatttttgttgttttcagtttgagactattatgaataaaatcaatgggaacactctgtacatatcatttttaaatacatgtactcatttatcttggaaaatatatctagatatatagcaaaatatatctattattgcatcatagggcaggcatatgggttatttaagtattctgtcaaatgtttttccaacatagttaaaattttactcacaccagcaatgtataaaagttccaggtgcaccacttccatgttgacacttactattgtcagtatttttaatttaagtcattcttatggtcatgtagttgtaactcattggtggacttaaatttacctaataatcattgatgttgagcactttttcaaatgccctattggccatttggatatctttttttttgagaaatgcctttcaagtatttagctcattgttaaaaaaaatcaagtttattgaattataagttacataaaataaaatgcactaagttaaagtgtacagtttgatgaattttgacaaatttattcacctatgtaaccaacacaattaaaatataggacatttccatcactacctcaccccaaattcccttgtgcccctgtgcagtcagttctttcacccctaactccagacaatcattgatctgtttttttgttatacttttcttgttccagaattgcatataaatgaaattatatagtttgcacccctttgtttcttacttctttcactcagcagagtgtttttgagatttatccattttgttgcatgttccagtagtacattccttttaattgctgaatagcattccattgcatggatatacagaacattgtgtattcattcacctgttgataaacatttgggttgtttacagtaaaaaactgttatgaataaaggtgctatgacatttgtgtacaagtatttgtgtatatatgtatgcttccatttatatatatttatatatatgcttccatatatatatataaatggaatatttatatggaaaatggaaaatatatatgaaaaatatatataagggaagcatatatatatatatacacacaaatacttgtgtgtaaatgtcatagcacctttattcatatcagtaaaaaactagaaacaaccaaaatgtttatcaacaggtgaatgaataaacaatgtataaatatatatatatgcttacatatacatatatacacacacatatatatatgtacacatatatatatacacacatatatacatatgcttccatttcttttggataaatatgttggagtttaattgctgagttatatcataagtatatgtttaactttgtaaaatgttctcaaacttttttccaaagtggttatacgacttaacattccctttattgatgagattacttgtgttttcatatccttgtcaccagcagtcttttttttttttttttttttttttggagacggagtcttgctctgttgcccaggctggagtgcagtggcgtgatctcagctcactgcaacccctgcctcccaggttcaagcaattctcctgcctcagcctcccgagtagctgggactacaggcacacactgccatgcccagctaattttttctattttagtagagatggggtttcaccattgttgcccatgctggtctcgaactcctgagctcaggcaatccacctgccttggccttccaaagtgctaggattacaggcgtgagccaccgcgcctggccaactagcagtcttttaatttttctgagcattgagcattttttcatatgtttatttaccatccaaattatccttttgtgatgtctgttaaaatattttgcctattttattgttataagagatctttatgtattttgtgtacaattcctttatcagatatttgacttttatatacttgctcctaatctgtgatttgccatttaactttcttttttcatttcatttcattttatttttaactgacaaatagtaattgtacatattcatgtggtacatagtcatgttttgataaatatagtatatcatgatcagtttagggtaattagcatatctatcatcttcaacatttatcatttctttgtgttgggaacattcaatatctttcttttagctatttgaaactatataatagtttgaaactatataatatgctgttgttaactgcagtcatcctatagcagtatagaacactaaaacttattctttctatctagctataattttgtattccttaacaatctctccccatctctccatttccccctacccttctcagcttctagtaccctctgttctactttttacttctatgagatcaatttttttttagcttccccatatgagtaagaaccggcagtgttgacctttgcgttcctggcttatttcacttaacataatgttctccagttccatccatgctgctgtgaatgacagaattcttttcaatggctgaatattctattgcatatatatatatatatacacacaccacattttctttatccattcatctgtcgttagacacctaggttgattccataccttggctattatgaatagtgttataataaacacaggagtgcagatattttcttgaatatactgatttattttcttttggataaattcccagtagtgagattgctggatcatatggtaattctatttgtacttttttgaggaacctctataatattcttcatagtggctgtactagtttacattcccacgaacagtatataagagttccctttcctctactttctcaccagcatttgttatttttttgtctctttgatgatagccatcctaactggtatgagatgatacctcattgtggttacgatttgcatttctatgatgattagtgatgttgaggattttttcatatatttgttggcccaatgtttttagcttctttcaaagagaaaataattttgtgaaagtccaatttattgtactaggaacaactacatatgtaatgcttttagtacatatctgtaaatatctgacataaattataaccttatatcctaaaaccactcatcctgatagagtctattttcttcattttactaaagggaaaacaaggttcagaagtattaagtgacttgttagcaatgtaagaatggcttgatttttttaaaaaaaagtattaagtgacttgcttgaggctgcacccagaggtaccagagttggtattcaaaccccatccatccaaatggccccagaaccagaacttcttgcactacatgacactgccctctactatctgcatcctctgaccacctctttacaacagatgagacaaaagggtggagcattatgttgctcaacctcagctggaaacatgtattttggacaactcaatattttcaccctacacatattagataaagtagacttcaaagcaaaaaacaaataccaaagggagacatatagtgataaaatagctaatacaccaagacgacaaagcaatcctaaatgtgcctgcatgaaacaacaaagctgcaaaatacatgaagcaaaaactgatagaactgaaaggagaagcagacaaatccacaattatagttggagatttcagcatccctgtctcaataactgtagaacagttagacagaaaatccataaggatatagaatagctcagcagcaccatagcctgttagttgaatctaattggcatttataggacatcccatccaaaagcagaatacacattcttttcaagtgttcatggaacatacaccaagatagacaatattctgtgccataagacaaacctcaacaaaattttaaagttgaaatcattacagaccatgtcttacaactataatgaaaaaaaaaaaacgtagaaattagtagcaataacatgaaactctctaaactctaggaaagtaaacaacacacttaaatcatccatgagccaaagggaaagttgcaaacaacattttataaaaatacaaaatacaaaaaatacattgaattgatctaaaatgaaaatacaccatatgaaaatgtgtggagcacagctaaaacaggtctgagagtgaaatatatagcactaaatgcatgcattagaaaagaggaaatattgcaaatctataatctaaattctcacctcaaataataaaggagagcaaaatgtacctaaagcaagtggaataaaggaaataataaagacaagaacagaaaccagtgatattgaaaacagaaaagcaataataaaaatcgatgaaacaaagagcttgctcttttaaaagatcagtaatagtgacaaacctttagcaatactgacaaaaacaaaataaaaaaaacaggccgggctcggtggctcacgcctgtaatcccagcactttgggaggccggggtgggtggatcacttgagcccaggggtttgagaccagcctgggcaacatggcaaaaccccatctctacaaaaagtacaaaaaattagtcagacatggtggagcatgcctgtagtcccagctactcaggaggctaaggtgggagaatcacctgagcccaggaggtcaaggctgtagtaaaccatgatcgcaccactgcactccagcctgggcaacagagtgagactctgtcttaaaaaaataaagggaaaaaaaatcacatattacaatattagaaatgaaacaagggatatcactttacactatgcaggcatcgaaagtataatagagaattataagaataattctacacatataaatttgaaaacttagatgaaatagacccattaattagaaagcataaacaactacaactcaccaaatatgaaatagattattgaatagccttataacaataaaggaaatgaaatcataatttaaaaattgcccagaaaaataaatttccaagctctcatgacttcactggagaattctaccaaacatttaaagaaaaatgaacaacaattctatacaatctattcaagaaaatagaagactagggaatattctttttatgaagctagtactatgctgataccaaaaccagacaaaatctgtaccaaaaagaaaactacatacaaataatttccctctaatacagacacaaaactcttcaacaatattttagtaaatataattcagtaatgtattttaaaaatgatacgccatgaccaagtggagtttactccagggctatgaggccagttcaatatttgaaaattaatcaatataatccactatattaacaggctaacgaagaaaattatcatatgaatgcattaaaagcatttgtcaaattttaacactcattcattataaaaactctcagaaaaatagtaatagacggtaatttcctaaacttgataaagagcatgtacaaagcacctacagctaacattatacaggaaaaaatatttaacgtcattagtgtaatgcacattaaaactacaatgagatatcactatacacatattagaacagcaacaacttaaaaatgacaatacctaatgctgtcgagaatgtggggaaatggaatctttcatacattgctggtggggatgtataacctttctaggaaacagattgacagtttcttcaaaacaaaacaaaacatatacttgctatataaccagcagtcatactcctgagcttttattcctaagaaataaaaaattatgtccacacagaaacacatacacaaatattcatagtacctatatttatgacagtcaaaatttggaaacaacccagatacccttcaatgagtgaatttgtaaactgttgtaacatgcgtacaattaaaaagaaacaaactattgctatacacaacaacctgcctgaattgccagagaattatgccgagtgaaaaaagccaatccccaaaagttacatgctgtatgattccatctatataacattcttgacatgacaaaattataaagattgcaaacagattagtggttggcagggatgaaagagggagtagaggtggaaaggaaatggaggtgaatataaaagaaaaacatgaatgatcattgcgttgatggaaatattttgtatcttgactgtatatatatcggtattctaattgtggtatttttctatgctttttcaagatgttactgttgagaaaaactgggtaaatggtatagaggaactttctgttaatttcttccaaatgcagatggatctaaaataatctcataataaaaatttaatcaaaacattttctgagatcataggaggaagtctcaggaagctaccacttttggggaaaagcaaaacattggaaaggcagcaccccttagagacttgatgaaggaaagaaggatgcaagaagggaaattaaaattcttgcagaaacaacaaaaacagaatgacagaatcagaaaacacaccatgaccattaatcaccaccatcatcaccatcaccaccaccaaaaaccccaactttgttacaccaaagtaaagggcactcttgaaacaaaaaagcttatttcacctctacatcccaatgcaactgttcttgctgtgcaggaaaatattttatttaaaaatgacctgaaggtggctgtcaatattcatacataggtactgtgaacaaagtcagaaaattagaatcaaaacattttggcgataaaaatttcttcccaaatcaagcatgaagcaaaaggaaattgtgagacttcacaaaccagtaaaaatgctttaaattagaaattcaaagctcatagcagaagtggacataaaaacaaatgtatgtaaaataagagttagctgaattcaagaaattaattgatgtcaaaatcatcatagaaatgaggactaaattgtaatcaataagtgaaagacagcttggctcacactgtatttccttgagtttcttgaacatgctactccattgttgtcttgctttctatgttattgttgggaagtttggtgctaaacttattttcattcttttaaagttacttcaactttttgccaagaggccctgagctttatttatttacatttgaagtctaagatttggcactgagatttttattggtgccaaccattctggatcatctttcccccatacatgacggactgtatctagtatgacaatgctggttttattttgttgctggaaagtttttttcttttaagtatacttttaaacattagttctgttttattgttacatggggaatacatggaggtaaagggatatcaaataaagattaaatctgacaaaccaggtagtagaaggttaagtaaggaaagtaagagtattataaaagacagtagtgtaaaggtaaccactagaacaaagtgacaaacctgcctaattaccaaggcaggaaaagagcccacatagacacacagaaagtacaatataatacttacagtgtgacggctcccatgagatgtcagtttggctgggctatagcccccagttgttccatcaaacactaatctaggtattgctgttgaatgttcttgctgatgcaattaaagcccctaattcattgattttaagtaagagagattatcctggataatctgagtgggcctgactgaatcaattaggtaagtcttaaaagcagggctgaagtttctcgaagagacagaaaaaattcttcctgtggacaacagctttggcctgtgcctgtggaatttgagcctgccagtgaacttcccttcgtgactgcttgccctaaggatttcaggcttttttagctaggccctacaattgcataagccaattcatgtaacagacatacaccctacatgttctacttctctgattcaacctgactgacacacacagtaatagaataaaatagtatgacagagttgaaattaaacatatcagtgatatcaataaatgtgaatgggcttaattcactatttagagaaaatgattcagaggaaatacaaggtgagtctggagcatcttgtagtaccacaaaataaggaagtagtttttctaaaaaaaaggtagggcatgtcaaagtgacacagaaggacagaaggcaatgtgaaagagctcccaatgagcaaagatggaaaaatctgaacaacaaagtaaatcatgtactactggattattacccaaagtacaaaataaaaatatttgaatccttagtggtataaatagatgattgaataaataaataaatgagggaaacaagacaaattttcttacaacagaattccatgtttatcagaaatttgttagaaatttctatagattctcccctcttggagatgatgcttaattattattgccaccaccactccttgagtttgggcaagacttagtgacttctttccaaacgaggaaaaaaatcatctttacagtaaagaaactatcacaactggcatcaggatccctcatgtgactcccccatatgctttaaatccctttgacttccccttttgctactagctggagaaaactgcatttaaaagtgttcatgtgatttgactaggctcacctgaataatcttccttttttgaggtcaactacgctgtgtaacacaatcatgagaggtatctcatcatatattaatatatctatacaggttctagagattagggtatgacattttaggggccattttaagaattctacttaacataccgtcatataaatatacatttaaaattaatagttgggtgcggtggctcttgcctgtaatctcagcactttgggaggccaaggcaggtggatcacatgaggccaggagtttgagactagcctgaccaacatggtaaaaccccatctctactaaaaatacaaaaattagctgggtgtggtggtgcatgtctataatcccagctactagggaggctgaggcaggagaatcgcttgaacctgggaggcggacattgtggtgagcctcccacctcaccattgctggtgagcactccagcctgggcaaaacagcaagactgtctcaaaaataaataaataaaataattaaattaaatcacacttacagaaaactgcatttgtatgaagaggtttttcttttcggagaaattgttctccaagaatcatcaggtctaactgtaatacaatttattggaaatttattacattgttatcacaacctaaaaatgcatgttgctttcattatgtcaattaaaaatgagattacttgccaggcatggtggctcacgcctgtaatcccagcactttgggaggccgaggcgagtggatcacaaggtcgggggattgagactatcctggctacggagaaaccccgtatctactaaaaatacaaaaaaattagccgggtgtggtggcaggcgcctgtagtcccagctactcgggaggctgaggcaggagagtggcgtgaacccaggaggcggagcttgcagtcagccgtgtttgcaccattgcactccagcctgggcgacagagcaagactccatctcaaaaaaaaaaaaaaaaaaaaaaaaaaaaaaaatgcggttactaaaattaaaaactttgaggatctaataaataattttcacaaaagtgagccaaaaaaatcttatgatcaataaaaataccacattaataaaatattattcattgtattatataaaattttgacaccatttttgcaatttgtatgtttatatatcattcaggtatcatgtatcattgcatgtgcaattaaagcccctgatccactgaattttaagtaagggagattatcctggataatctgagtgggcctgactaaatcaattaggaagttttaaaagcagggttgaggtttctataagaaacatttatgtatcattgttatctatattacattttatatgtaataaaagattttaaggaaaaatgttgatattttagtacctttaacatttttaaaaagctttatgaataaggggccctccattttcatttgcactgggtcccacaaattatgtacccccagctttaacccgacaagagcattacaaaaaaagcagattacaaaccaatatccctcatgaacatagatgcaaaaatctgttaaaaatattgacaattcaggccgggcacggtggctcacgcctgtaatcctagcactttgggaggccgaagccggcggatcacgaggtcaggaattcgataccagcctggccaacatagtgaaaccccgtctctactaaaagtacaaaaattagctgggtggggtgatgggtgcctgtaatccttgctactcaggaggctgaggcaggagagttgcttgaaccccggaggtggaggttgcagtgagccaagatcacaccactgcactccagcttaggtgatagagcaaaagcaaaactccgtctagaaaaaaaaaaaaattatatatatatatatatatatatatatatatgtatatatatatacgtatatgtatatatacgtatatatacatatatatacacgtatatatatacacacacaattcaaatccaccaatatataaaaggaataatacattatgaacaactagtgtttatttgaagaatcaaagttctatttaatgttcaaaaatctatcaataatattaagagaacaaagatttttaaaaaccatatcatcacaacaaaggcaggaaaatcttacaaaattcaataacaattcagaatgaaaagaaaaattcagcaaactagggaacttcctcaacctagaaaaaccaacagctaacataacatttaattgtgaaatattaaatgcttccctcaaggttagaaacaagacaaaaatgtctgctttcactatttgtattcaacattgtactggaggccctggtaagtgcaatatggtaagaaaaataaagggcacaaatattgaaaaggagaaaagttgaactagttttcttttttttcatacccaacatgattatttacatataaaccctaagaaatattcaaaaaatggaaaatttacaagacaaaaggtcaatacataaaaaccaattgtatttatatatgcaagcaacaaataattggaatatgaaatttaaaaatttaccaaagctcaaaatatagtattcatatttaataaaaaatatgtaggctctctacacagaacactcaaaacgttgaagacctaaataaactagggaatgttttcatataaagtgttcatggcttagaagactcaatattttaagatctgaagttatcgcacattcattcttgctttcaacaggattctgttaaaaattccagctggattttttcatagaaattgtcaggatatttctaaaatttctatggccatgcatcttgactagaataggcaaaaacattcttgagaaaaagattaaagtaggagtatttacgctgattttaatatctaaaataaagctatggtaatcaagataatatggtatttatatatgaaaacagatccatggaacagaaataaagtcaggaaatagaccaactcacgtattaccaagtgatttttgacaatgacaccaaggcgtcaaaacaactaaatatcagcattgaaataaatgaaccttgtttcataccttataccatatacaaaaataaactcaaaatggatcataaatataaaaactaaaactttaaaactcttagaagtcataagagattatctttatgaactggaggctaggcaaagtttttttaaatgtataaagcacttaagttgatcgcataaaagtagagtagaatagtgataactagaagttgggaagagtggagggaaagggatagccaaagattggttaatggatacaaaattaaagctagataggaggaatgagttctggtgttctatagaactgtaaggtgattaagttagcaataatttattctgtgttttcaaagaattagcagagaggattttgaatgttcccaacataaagaaatgataaacatttgaaattataaatatgctaattaccctgatttgatcattacacattgtgtacaggtgttgaaataccacactgtactccataaatatgttcaattattatgtgccaattaaaaataatttttatgaaaaatcaagtctgtcttagaaataagtaaatacaagaacaatatacactaaaatgcataagagaaaagacaaaagcaaaaaatgatgaaataaaaaatgatatgtgtatttcataaaaaccaaaaatgtctactcatcaaaaaacaacattaagaaaataagaagacaagccattgtactgaaaaatatatttgtgaaacatataactgacaaatgactcacacacagaacatgtgaagaactcttacaactcaatgataaaaataagcaacccaataaaaatgtctaagtttttaaaacttagacatttcatagaagagtatctaccaatggccagtaaagatgctcagcaacgttagccattgagttaaagccatagcaatgtactactacacacacaccaagatggttacagttaagacgactttcaatatcagatgttgcagaggttgaagagtatctgaatctcttgtatgctgctggtggaagtggaaaatggtataaccacatttcaaaactcttataactccaaacatatactatgtggtagggttcttcagagaaacagaactaatggggcatgtatagatgtataagacaggttatgggaattggcttatgttattatggagactaataagtcccacaatctgccatctgcaaattgtataattaggaaagcaggtgatgtaatttagtctgaggctgaaggcctgagaatagttgggggtgggagtgaagaaggggtctgctggtataaatttcagagtcccaaagcctgaaaactagcagctctaatgtcccagggtaggagaaatggatgtcctagttccagaagagagagaagagggaattcactcttcttccacctttatgttctatttggaccctaattgactggatgatgccagcccacattggtgagagtggatcttttttactcaggctactgattcaaatgctaatctaatctggaaatactttcatatacatgcccagaaataatgtttagtcaaatatctgggcagtttgtgatctagccaagttgatgcataaaattaaccatcacatataactaccttataatccaacaactctactcctagataattattaaaagaaataaagaccatatatccacaaaaaatcttaagcatgctcattgcagctttgttcagaatagcaaaacattggtaacaatttaaatgtgcatcaaaaggagaatgcataagtaaagtgtgatacatttacatgattaaataacactcataatagtggttgcctctgggtggaagggggataattaacttgaaaatggcatgggggatctttctaaagtgctagcaatattctgtgtctttatattggttttaattacacaggtgtgttcatttgttaaaattctgatcaacctgcacacttaagatctgttcattttaccaactgtaactatatctaaacaaaattaacattaaaatgtatgttattaaaccagcgtttacggagaaatatatagttaaatatacaaatgtaaaatatatagtatatatttaaagaagaaaaattaaaaaattatcaggaggctgaggcaggagaatcgcttgaacccaggaggtggaggctgggctgcagtgagctgagattgcaccactgcactccagcctgggcaacagagcaagactctgtctcaaaaaaaaaaaatcaacaatctacatgtctaactcaagaagataaagaattgatagattctgtggcaagactgatcaagcaaataaaagagaaaaaacagaagttaccaatttcatgaatttcatttaatatcctacagatattaaaatgataataagatattatgaagaattttatgccaaaaactttaaacttttgataaaacagacaaattcatttaaaaattttaccaaaaccaacactagaaaaattgaaaatgtgaagagtcctgtatctattatactaaagaaatacaaaaccataattaaaaaccatgccacaggaaataaaacagccaggccagatgacaacactggtgaattcttctaaatatttaaggaggacatgtaacacaaattgcttttgagggaagaaaaacaggatacattagcaacttgttttataaggcaagcataatttttacttataatatgaaaaaagacattattttaaaaggataattataggtcaatatctgtcctgaacataaatgcaaaagacctaaaatttttagcaaattgtatctagcaatatgtagaatactgtactatattataaatacatagtaaaatttattgtagtaggagcagtgtttcagtatttaggaatttagggtttaaggcaactttatagagcataactactttgaataatgagaatttactggaaatacatacagccatccctcagtatctatgtgggattggttccaggatccccctcaaataccaaaattcatgggtgctcaagtccctgatacacaatggtgtagtatttgcatatcacttatgcacatcctcccatatactttaaagcatctctaggttacttgcaacacctaatacaatgtaaatgtcatgtaaatagttgttatactgtattgtttagggaataatgacaagaaaaaatctgtacatgtaagcacagatataaccatctggttttatttttcaaatattttttatctgtagttggttgaatccacaaatgtggaatccacagatactgaaggtaaacagtataatcataatccatcagtgttattattttatgggttcaagtaaagtgtagaaaccctacctccttttacattcctgagtccttccccatttatgatataattgtcttaaatattttttacatatatttagaaccacaacagtgttataatttttcctccacatatcacatataatttaaaaactcaagaatgaaaatttcttgtctttactcatttttttaattttatgatctttcttccttcctgatgtcccaagatttattttttgtcatttcctttctgtttacagacccattcttagagggtagttctgctagtcacacattttcttaatttttcttcatctgaaaatatcttgatttccccttcattcttaaaggatattttttctggatataggattctgagctgactgttcttttgtttcagctattgaaaatgttgtgccattttcttttggtctctctattttctgacgagaaatctgatgtcatttgaatagtttttcctcccatggataatgtgtcatttctctctcactgctctcaaaatttttcttatttcttttttagttttcggaaatttgactatgctgtgtcttagtgtagattgcttggggtgtatactgcttggggtttgcccagcctctgaaatatgtaggtttgtgtcttgtaacaaatgtgagaaatttcagctattctttcttatagtacttttccagccctttcctttttttcctcttttttataggactccagtgacgtgaatgtcctgttgtttattatagttctacaggttttgggggctctattcatcattttcaggctatattttctctctattggttaatttccattgttatattttccagtttactaatttttttcctctgtcctctccattctgatgttgagtctgtgcaatgaattttaaagtagtgttatagtatttttcagctctaaaattttcatttttttcttttatacatgttccatttctttgttgagacacgctctcttccttgagtctctgtttttcatttgcttcaagtatgtttgcaattgttcactgaaacatattcatgatggctgcttataatcttaggtaattctaacagtgggagttgaacaatgagaacacatggacacagggaggggaacatcacacactggggcctgtcagggggtggggggctaggggagggatagcattaggagaaatacctaatgtagatgacaggttgatgggtgcagcaaaccacaatggcacatgtatacctatgtaacaaaactgcacgttctgcacatgtactccagaacttaaagtataataaaaaatagaaattatatacatttagggtgtacagcttgatggtttgatatatttatacactgtgatatgatcattacaatcaaggtagttaacatacctattacctcacatagttaccactattttgatgttcagaatatttaggatccaccctcttagcaaatttcaattactgtatgcagtacagtattgttaactaaagatgctgtgctgtaaattagatctccaggactaatttatcttgcataatggacactgtaccctttgaccaataattcccctttctctatacctctctattcctctttctctaaacctctggcaacccattctactctgtgcttttatgagtttgacaattttatagcccacatataagtgagatcatgcagtacttgttcttctgtgtttggcttatttcacttaatagaatgtcctccaagttcatttgtgttgtcacaaatggcaggatttccttccttttaaaggctgaatgatatcccgttgcatatacaccacattttctttatccatttatctgttggtagacatttaggttatttccacatcttagctattgtgaataatgctgcaataaacatgggagagcaaatatctctttgaaatactttttttatttctttgggatatatgtccagaagagaaattgctggatcatatggtggttatatttttaatttttggaggaaccgcctcattatttttcaaaatggctgtaccagtttacattttcaccaatagtgtatgagggttcccttttctctacatcctcaccaacacttgtcatcttttgtctttttgtaataatcatcttaacaggtgtgaggtgatatctcattgtggctttaatttgcatttccttgatgattagtgatattgagcacattttcatatacctgctagccatttgtatgttgtctttgaaggaatgtctgttgaagtccttttccattttttaaattggagatatatatatatatatatttatatatatagctattgagttgtggaaatcccttatatattttatttgtctgtgttaagaataaggaattggctccctagcatctcccaaagctgaccaaataaatgtgttctggcttgcttttttatttcattgtattttatttattttagttttgctcggttgctcgggctggagtgcaatgatgcaatcatagctcactacagcctcaaacttctgggctcaagctatcctcctgtttcagcatcctaagtaactaatactagaagcacacatcaccatgcctggctaatttttttatttttattttttaagagacagagtctcgctctggacccgggctggagtgtagtggcacgatcgtagctcactgcagccttgaactcctgggctcaagcgatccttccacctcagtttcctgagttgctgggactacaggcatgcaccactgcacctgcctcctttgcattgttttaatatcatgatgagttcatgtatctaaacatttttatatgttaaaatgactgcagttattgttctttttaatgatcaaattgttctatcttccactggaaaccacttaggttggcttctgtgtcctttttgacaaaacctaaatagcgtttgttagttttcttgctttctggcacgacagaaaatagctttgaatcatctttcttgatatatagaatgatatttgcatgatatatagaatcacccattataatttgaggctcatcatatatatttcctgccacagactcagtatgagctatttcttcaatgaatcctgattccttttaatgggaaatagtgtttagagaccacaatctgaatgctgtggcagttagtttgctactatgttcatattttctaagagttttctatgatcagagctattaaataaatatgtgttaagaagattacatcatgagttcatactaacatttcaaatttaagtatagggttatagggtttttatttattttatttcattttatattcatatctcttttcccatatgttgaaaaccttaatttgctttattctaaaatatttattatggtgctatgtatggactgaatgtttgtggtcccccctgctaaattcatatgttaaaatgctaatcccaatgtgttggtatttggagatggagcctttgggagataattagatcttgaaggtagagtcttcccaaatggaattagtgcccttttaagaagaggccagaaagccagctaactctagttctgccacatgaggacacagtgagaaggcagctgtctactagacagaagagggctctcaccagaacccaatcatgctggtactctgatcatggacttccagtctccagaactgtgagaaataaatatctggtgtttataagccacctagtttatggtattttattatagcaacctgaactgaataagacatatgttttcataaccttaccaatgttattgctaacaatatggctactgaaaatgctttaagatttatttgtagctgcttttgttcctaaggtatgtcccactgtggatgtgtagttaaagtattgtgttttacaatcacttgaaataattcctttctgtatggttaaggttatgttaccatctcaatataagttaaattcatcagtttcatttcgtgttttgatttttagtgattgctttatcattttattttactttttaataatttataaaacagcattatggttccaaagacaaatatacaaaatacattacatttacatacgtttagcttcctttattgttcttttcaccctggtttctccctcctcataagttgccatttttattatttttggtttatccttccagtattattttaaaatatacacataaatacacattcctattctctctctttatcagattaaagctatcatactgtatacattattctgcactttgtttttataacctaacagtagatcctggagatcacttaatagcagcacatacgaagattcctcatccctttatgtagctacataagcttttttttttactgtgtggctatgagtaggttattcagtctctaaagagagtactttaataggaacagtgtcacgcaacaagcctgggaacatagcaaccagggcacaaagaaaaagtgtcaattccaagttatgggcagttactggcttaaagagaaaattgctcaaatagtgaaagcaacatttcaatactgagctgtttgtggcaaaaaggaattgcatactcaaaccaaaagtgtgttaaattaatacaatgggggaaaattacaaccattgaaagagactgataccttggtttattagggaaaaaaaaatatgctttggtaggatgattgctgcttgtagaactgccaaattggggactgaatgaaaaacactcaggtataatatagctacctcagagtcttttaattccacataccaaggtagatattaataataatatatattttttaattcagaagatgttttcccacatagctgtggacaacacaaggcaattgttagaggaaatttgatgaagttgtcctgacattgttctctcagtgggtttcccctctattatttcatttcatctttacaactacctttacagctatggtgttattattttctctatttgagatgtgagaatgttcagaggtgtgaaatgacttatccaagatcacttaggtgtccagtgaaaatagctgccattcctagcccagtgttttttccatgacatcagaaatagtacagtaacaatcaagtaaggcctaatcaagtcgtctagtcaaattttgaacatactcaacccataaaaattcttgtgctaactctaagttcagcagttccctaaagggtctagggatagagcagagaagagagggctgataataatcatgtaaaccaacacgataatttagcagctgagatacttatctattgttgcataacaaattattctaaaacttagcttaaaacaacaaatatttactgtatcaagcagtttctgagggttaggaattcaggaggagcggcttagctggatagtctggccccagatctttcatgaggttgtagtcaagctgtcagcaaggggtggagaatctgctgccaagctcagttatggggttgaaagaagcctctattttttgacataccacgtggacttctccatggggctgcttgatatggcagctagcttccttcccccagtgtgagtgatccaagtgagacagaaagcgcaaatgaatgagagtgcccacggtgaaagacgaagtcttttttttataaccccgtctcatcacttttgccttataacatagaccaaatccaatgtgaatgccaggaaacagggatcactggaggcccatttgggatgctggcaccacaatagctaatgctgggagaagtcttactgtgcatcagacactttactgagcactttatatgtattattttatccatagccctcacagtgacactgagaggcaggcactattattattcctgttttacagatgaggaaagtgaagctccgaggtgttgtctgagtgagtgaacttgtccaaagtcacagagctagaaagtgttagagccaggattcaaactcaggtagtctggcactatctcactaagctatattgtctctatgttcagatattagtaagtgctatgaaggaaataagataatatgatggagtgactggagtatggatcagacagggattttttattttgttatgttttaaattgagttgtcagggtaaaccactctgtagaggtgatacttgagttgtgacccaaatggtgagaggaaagccagcctcatgaattggtgaagatacactttagacagagggaatataatgtgcaaagacctcaaggcaggaaaaatcttggtatattgaaggaacacaaagaaatcagtgtggtttgagtatattgcgcatgaagggatgggaataggatctcaggtatagagaagacatttgtacaatcccttctctgtggggagctcagagaatcttctcccccagagagatatttgttacactggtcaaaattatcaaagaaaacctttaaaagtctctggagattgtccaaaactgggagggatttattcaacaaatttgatcaaaacttgtatgaaccacagcaggccaaagcacctgagccagaggctgcacccatctctcctccagctctgtgtatggaggaactactctgggcagactgaacagattccacagctgcaaccaagtaggcagcttgtgttaccccatttctctggtattgaagatctatatttgcaaggcagtatgagctggtaaacaatagattccatttcctgccatctctctcatttctcctatctcccccatcttcaggctgtagaaatctacattgggtggtggcaatagccaggtggtgttgtctgcttcctcaacccacagcactcactttgttggaaagaggcgggtggagcagtaagtgaagaacagtgtcctccaattctcctacaactctcatgccatggcattgcagttctacctgggagaaggggtgaggcaaactgcaaagactggaagatctggctccagcagagaaggagatttcatttggttcagagaatggtggaattcatgccctagggtatgttgttgaaactataaaaatcagtgtctagcaattggaataacagcttggtaatagcaatagagggagaccagccatgagtttaacaggtagatccaggaaagagacagtctaagaaaaccctgctaaaatcacacccatctctggtggtcaggaagacttccatgctcaaggctgcactttctcaggctgactagaaaacggtactttcaaaataagttttccccttaacagagaaagtaatctccaagccatacatagatcctgtggtaaagggtgaaaactactggacctgggaacttatttacaacttttgaccagtcagtggctaaccactaagctatgctgatctagaggcaacctctgggaaattggtctttaaaacgaaaacaaggggaaaaaatcttagcagggacatctggggctacacactgcaggggaaatagacttcacagaattaatccagacatatcaccaaacaaataaacaaatgaacaaacaacatgaacaacaagccccaaagggagaatagtatctagagttgctacaatattttatccaaaatgtccaaatttcaacaaaaaatatgagacatataaagaaacaggaaagtattgccctgtacaagaaaaaagagcattcagtagacctgtctctgagtggacccagatgtttgcttagcagaaaaagacttcaaagaaacaattataaacctgttcaaataactaaaggaaaccacatttaaataattacatgaaggtatggtgacaatttcttatcaaatagagaatatcagtaaagagacagatattataaaagtagcacagtagaaattctggagttgaaaagtacaatagcaaatgaaaaattcagtaaaagggcttacttaacagcagatttgagcaggcaaaagaaagaatcaacaaacttgaagctagatcaatcaagattttgcagtctgagggacaaaaataagaatgaaaaaaaatgaacagagcctcagagacctgtggaatgccatcaaatgtaccaccatatgcataacgggggtcccaggagaggagagagaaaggggcagaaataatatttcaagagctaattgctgaacacttcccaaatttgacaaaatacattaatccacatatccaagaaactcaagaagaccttctctagtttctttctccaaaggcttggtgtccttcagggaggagctccctagtttctcacctccctgaaattgggtaacctctcagtctagagaccagtagaagtgttgggcagggtggtaagaaggtctgctctggaaaattgggcaggttggactctgtacaagagtgtatggccaagggagtttaaaggggctataatccagtccattctccactccccaagccatatacctgattcagggttgcatctacccagaagaaaagccatcattttctaatctgcctagcgtctcaatctgctctccaagccctgtgcccatggggttgcatgtattaaagggacaactttttctaattctctcaaaggcacttctggattagtgtaggtcctgatgtggaaacagtagggaagtggtgggactcagggaagacagaaaagccacttcacagaggtggatacccatgcaattaaccatgtgggacttgcggtttactaaaactcgggccaccccaaaccttaccttcaactctgcctgagcttgagaatccaaccataagagtagctctgttagttttaatgattccaaaaggcttttgccgaaatacttctttgttacttaggtgaggcaacccagacctagcatggtagttaagagctgtgtgatcttgggtaagttgcttctcttttctgagtctcagccttttcttctatgaaatgggaaaataacaatccctacttcagaaagttttcataagaaggaaaaaaagagtttaagtgcttagcaaagtatttggcacataatagattcttttttttttttaattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgattcttaatatatgtgagctattattcatgatcaaagtgttgccaaaggcaggggcagtgtgtgactcctgacacagtgctcctaactgtaccctcccttaccagaagggctggagtctccaggaatacagtcttatccctgggggcattcatccccttttccttggctctgcaaggtaacttctgcactcacttctcttcaggctacattggctggcactggggctagtgagcacagtcctggcctcttggagctggaaagggtctcagagggcctctggttttccaaaggccactgtgtgaacaggcttcagatcaggagcataggggtcacttagtaaaatgcagatttcccaaaaccttcctacagagattctgtttcaggaagcctgtgttgaacttggaaatctgtgcttttgactagtgccccagattattcttgtaccttcttcatactccatgcccacaattgtggaatgcaccctgtagggccccaaccacctataccagggataaggaggcaggctgatgggcaggcaggctctggctgtcaaaaggtttgtccccatctaagcccacttcttctacctcccataacttagtgacaacactaggtttgagcttcgaagccacaatacagaaaccagttttctcctttattctcatgtcaccaacagtgacagccatgcacctcacaactgaaaaaagctcctgtctccaaccggccctcttcatgcttcatttctccagactgagcaaccttcccaccctctgtgtaactaattggcttagagatattactgcctcaccagtgggctaggaaactgagctcttgccttcagctttcattgcttttccaggcatggcggagcagtagtaggtggcagctgtgtcccaaaatgtttccattctctctcccttcctccctcctttcttctcttcttctgatcctgtccaagactgacaggcgttatgggagcactgtcattttgctgctttgagtcccccaaaaccaacatgttgaacattgctctatacacatcatacagagggcacattagttttgcttggtgagcacaccctaattgggttcccagagggaaattctaatgccagtgcagagaattaagaaccagccaacagatggggtgagaagcatgatgaggagggtggcagccagggccacatcttctggagtctatatcaaccatgagactgacaggttggatctgggggaagcagctaagctcccagtggaaagattggatcagatggcagaatgaagtcatttttcacaatatttacaaagtaaatatctgcccactcagggatacctttgcagaatatgaaagcagccactttggacctgctattttgttttgttttgtcactttttgagggggtgggggaaggagggtattttcctcctgggttccttggacatagactcaagtcatgaggcccatattcctatccaagatatcccagcctaataatccccagcctgtgggttgcagactccttactgcaagtagtccacaaatccacatgcttcaatgttccatacttttgtaattgggtaactttctgaggtaccttttttttttccgagaaccttctttgaagtctcagttattagtttttctcttttctctaagcaagaattattcccttaatgatctcatccagtccccaaggtttactatcttaatcccttccccccaactctactgccaaaccctctccacctgcagccttcaccatattaacacctttacatcatccttgacacttctctttctctcacatcttacatgcgtctgttagaaaattctgttctactttcaaaacactatgtatccagaatccaactgcttctctctacctttacgttactgctatcatcctagtcggagcaattatccatttattcctggatttatgcagaagtttcctagctgttctccctgctgccacccttgcccttcaaagtttgttcttaacagccaagtgatgctttattctaattgaaatttttattgagctaattgtagattcacatgcagttgtaagaaataatttagagagacccattgacactttgctaagcttcccaaatagcagcattttgcaacactatagtataatatcacaaccaagataccgatacactgatacaaatcactaatttgattctgatttctccagttttactttatacttgtgtgtgtagtaagttctatacaattttatcacgtgtagattcacaaatttagcaccagtcaagatacagaacatttccacaaggatcctttgtgttgctcttttatagccatgcacacaaccctcctgtgcaccccacagtcccatccctaaactctggcaaccactaacctgtcattcatttctaatatttggcatttcataatgttctatgaatgggattatacagtgtgtcaccttttgggattggccttttaaaaaatttagcataattctccaagttgtgtttatcaatagttcattgccttaattgctgagtaatattccaaatattccatggtatattagtttgatagggctgtcataacaaagtaccaaaaactacatggcttaaaacaacaagaatttgttgctctacagctctggaggctagctgtcccaaatcaagtcagctgtctctgaaactgtcatggtagaatacttccttgtcatttcctagctactagtagtggctggcaatctttggcttgcagctgccatcagtccaatctttgcctacattatcacataaccatcttcatgtcatcttccctctgtgcatgtttgtctctgtgtccaaatttcccctctttattttattaaggagaggagggcaagggaacttctgggggaacgagggatcaaagaagaagcttaagtgtctaggttatatcactgagcagcagagactctgaagggtaacagtggcttagagtctttagccctgtggtttgtcttatctctggctaacaggtgttggatgcagttttgtggagtatgcaaagcaggaaggctctaaatgagtaaatatctgtttatttgagctacatttataacaaaagaatgtgtgaaaatttgaccttagtactgatgggcttttgagctaataaatcctggcttgtgaaaaaaataaacaagatagggctaacatacagaggccatctttgactcatttgtataacagtgggtcatatggaaactacatttaatatgttgaagaagtaccaaactgttattcagagtggctacattctcacccgtaatgtatgagtgatccagtttctcctcatccttggcagcatctgatgttgtcactattttttattttagctaagctgatagtagtgtagtgatatatcattgtgattttttttcacatttctttaatcactaataatgttgaatatctttccatgtacttatttgccatctgtatatcatcctcagtgaaatgtctgtttatgtcttttttctattatttaattggattttttaaactgctgagtttgggttactcctatactctaaatattgtcctttctggatatgtggtttgcagatattttctcccactctgtagcttgttgtttcatcctcttaatagggtcctttgcagagaaaaagttttttattttgatgaagtcttatcaattttttccttttataaattgtatttttagtgtcaaatttaataaatccttgtctagccttagaccctgaagattttctcctacttaaaaaacttttttaaaaagttttataattttatgttttacattgaagtccatgatccattttgaacttttataaggtatgaggtttaagttaagggtcatttgttgtctatgaatgtccaatacctctagcaccatttgttacaaagtttatccttcctccagtgatatattttgacaactttgtcaaaaattacttggacacatttgtgtgggtccacttctgagttctctattcagttccattgatctatgtgcctatccctctgccaattccacaaccttgattattgaaggcatatattaaaaccttcatattatttaacatttatttattatttataataatacttagtatttaatatttaatagtaaagctttaatattgggtagattgattatccctactttgtttttctttgtcgagatcattttacatattgtagggcctgcacccatccatataaattttagaataaacttttccatgtctacaaggaaactttgcagatatttttataggaattgcattaaacctgcaaatcatttggagggagaattgacatttttactatgttgaatcttctattccatgagcatgttattccattccaattatttagctattttaaaaatttctttcattttattattttcagcttacagatcctgttcaagttttgttaagtgcatatgtcagtatttcattttatttggagtgattgcaaatgatattttgtttttaatttcagtgtatacatgctcattgttagtatacagaaatgcaatttatttttgtgcattggtcttataaactgaaactttgctgaactacctataatttctaggagtttaaaaaattccctcagatttattacttaggccatcatgtcatctgtaaatagggaaaataggaataattgtgttttttcatttctgatttctaggccttttattccttttgcttgccttaatgcagaggccaggatttccactactaagttgaatgagaaaggcaagagtacatatcctggctttgttctcaattttagaggaaagcattcaatctttcaccgctaagcattgttacctataggtttttttgtaaatgctctttatcaagttctcaatcatataatgagacatactctgttcatggattagaagacttattaggagagttaagatagtaaatatgtcagttctcccccaaatgatctataacttaattcccctcctattcctaattttctaaaactttttatcataaatgggttttgaattttgtcaaacctgttttccacattaattgatataatcatgatttttcttcttgagcctgttggcatgagttataatatttgattttcagttattcaactagtcgtgcatacgtggaataaatctcacttgttataggtgtataattctttttttacattgttagattctgtttgctaacattttgttgagggtttttgcatctagttcatcagagaccttgttctgtagttgctttttttgtattatctttacacggtttttgctatcagggtaataatggcctcataaaatgagttgggaagggttcatccagtttctattttttggaagatgttttgtaaattcggtataaatacttctttaaatgggaggttttctgggaggttttaaattatgaattctttctttgatgattatagggatattcagattgtgtatttcatcttggttgagttttgatagtttgcgctttttgaggagttggtccatttcgtcaaatttgtgtgtattgagttctttgtagcattcctttattctcttttgatgttttcagggtctgtagtgatatcctctgtctgattcctgatatgggtaatttttacattctttcttttttctgtcaattttgctaatggtttgttaattttattggccttttcaatgaaccagctttttgtttcattaatttcatctatttttctgttattaatttcattgatttctattcttgtgtttattatttaatttctcctccctgcttgaatttattattttgtcttcttattccctgaggtaggaacttattgatttgacatattttctcatttctaatataaacatttagtgttataaattaccttctcagtatcactttagctgcttaccacaaattttgatacgttgcattttcattttaattcagttcaaggtattttttaatttacctttagacttcctccttgacccatgggctatttacaaaagtgttgtttagtttccaagtgtttgtttatctttctgttactgatttctggtttgattccactgtggtcagtgaatacattctgtatgatttcaatttttaaaaatttattgagtctcactttatgtaccagaacatggtctgctttggcaaatgttccacagtgtcttgaaaagaatgtgtattctgctgttttggggtgaggttctccacacacatcaattagaccttgttggttgagtgtgtttttcagatattctatatccttgatgatgattttctgtctcgtaactgtgtcaggtgttaataagagggtgttgaattcttcaactataattaaggatttgtctatttctccttttatttctgtccatttttgtttcatacattttgagattctgtattttggtgcatatagggtgatgctttaaaatcctaaattagattatgcttttcctccactacaaaacctcacaatgattccctatttcgggaggctgaggcaggcggatcacgaggtcaggagatcgagaccgtcctggctaacatggtgaaaccccatctctactaaaaccacaaaaaattagccgggcgtggtggcgggcgcctgtggtcccagctacttgggaggctgaggcaggagaatggcgtggacccgcgaggcggagcttgcggtgagccaagatcgcaccactgcactccggcctggacgacagagcaagactccgtctcaaaaaaaaaaaaaaaaaaaaaaaaaagattccctatttcattcagaacaattgatcaagttcttataatattctatagggttctacaagatctggctcccggtaacatctccaacttcatttcccactgttttcccccacacttactctgctgctgccacactggcttccttgaacagaacaggcacactgtctccttcgggcctttactgtaactcttcattctgccaggaatgctcctccaccttggaatgggggtctggggtatagttattgtaaaaattgttagctttacatatcagggaagccaaagcctggagagggtaaacatcaataacaaacagtgtataattggcagagccggtgtattatggagatcaaaaggtgagcctgaagaaaagcagtgagagaaaatgaatgaagagggataaacagcatcagctctggttttaaatataggaagaactgataccccaaattccctcattttaaaacgtctcttccagcagcctggcattagctctgaaattccagcagtatacttttttgggataagcatgtaaaggctattgtaaaggaatcctgcagtataaaactttgtataacagattttgttttagaacaaactttgtatacttagatttcaccaagagattcacaaaattatttgacaatagaacatctccccaaccccatgactgtctcacaaaatccattttggaaaacaatcattgaaagctttgtgtttccagaaaactcctgccaaaaggctaatattattagagagattcacctagtttagtctttccgactctgtgataaattattttatccaattaacttaggagatgcaaactatggcaaaggcctcagtcctcccccgattttgtaaaataaagtttgattggaacatagccatgtccatttatttctgtattgtctgtaactgcttttgcattatcatggcggagttgagtagttgtaacagaaactgcatggtcaggaaagccaaaaatatttactatctaaccctttacacaaaagtttgttgagccccgggtttacccaatagtaaggccctgagatttatctatcgctgcttaacaattgacaacaaaagtttgtggctaaaaacaacaattcattattatctataatggttctgtggattgggcgggctcagctgggaagttctcaatttgcttctttcattcagtgacagtcagagggcaactggagctacagtcatctgagagctaaactgggctaaacattgaaaatggctcacttacatagctggcagttgatgttagatttcagctgggagctcatcaggagctgttgactggaggacctacatgtgcttgctctttttaggttgggtttctcgcagcatggtaggtatgttcccagagggagcgtttcaagagtgtgaagtagataatgccagttgtgttaaatcctaggcttagaactagtgtaatgaaacttctaccttttccagttagtcaaagcactctcatgagttcagacccaagaggacttgaggaataaactctacctctgcacaaggaaagggcaacagcatacatggaaagacataatgacttctgattatgttgaagacaaactaccaccatcttcaatggagaatcagtatgaggtacttgaggagcagggtgcagcaggttttcctggaagggatttttagcgtgaatgaagccaactgtgttttcacccatgcccatttcatagataaatgtattgaggctcagagcattaggagaagctactgaaagtcggtgtctgtgtcacagtgttggcaaggaccttggttagcttgcaggaggtgtgtaactaactccaaagaagagaggggtctagagctaacagactggtatgagggggctgatggaacctgagcctttgaataaagccccttcctttccctaacatttccttaccctctactgctcgctcaggtgtgttagttactatgtaaatatctaggccttacagacaccctagattcctgccactatgccttgtaggcttctgaagtctttttcgtatctagactctgcactccaaataagctgtgaacactttgaacatagagatcacatctacaatttctttcacttctggccctgagatgtctcatatagatgttatatacacagcagataacagaaattggaggattatttgaatcacagctaatttcccagcatagcctgtgtaagtagtattctatggtttggtccctgcacactatactagccttatttttgaattttatccattttcagtaattgtgtttatgccagacattcagtcatacatattcattctgtctctctcttttctctcaatctctctctctctctctctctcacacacacacacacacacacatacacacacacacacacacttctggcctgatgaacacccttcctttccactcacccacaccagtctaccttttttgacatgcatcaggactcagcctgagtgtgttaaagaaaaaatggggggaggagccaagatggccgaataggaacagctccggtctacagctcccagcgtgagcgatgcagaagacgggtgatttctgcatttccatctgaggtaccgggttcatctcactagggagtgccagacagtgggcgcaggccagtgggtgtgcgcaccgtgcgcgagccgaagcagggcgaggcattgcctcactcgggaagtgcaaggggtcagggagttccctttccgagtcaaagaaaggggtgacggacgcacctggaaaatcgggtcactcccacccgaacactgcgcttttccgaggggcttaaaaaacggcgcaccacgagactatatcccacacctggctcggagggtcctacgcccacggaatctcgctgattgctagcacagcaggctgagatcaaactgcaaggcagcagcgaggctcggggaggggagcctgccattgcccaggcttgcttaggtaaacaaagcagccgggaagctcgaactgggtggagcccaccacagctcaaggaggcctgcctgcctctgtaggctccacctctgggggcagggcacagacaaaaagacagcagtaacctctgcagacttaaatgtccctgtctgacagctttgaagagagcagtggttctcccagcacgcagctggagatctgagaacgggcagactacctcctcaagtgggtccctgacccctgacccccgaggagcctaactgggaggcaccccccagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagtgcctctcctcctccaaaggaacgcagttcctcaccagcaacggaaaaaagctggatggagaatgactttgacgagctgagagaagaaggtttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgactggtgtacctgaaagtgacggggagaatggaaccaagttggaaaacactctgcaggatattatccaggagaacttccccaatctagcaaggcaggtcaatgttcagattcaggaaatacagagaacgccacaaagatactcctcgagaagagcaactccaagacacataattgtcagattcaccaaagttgaagtgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaacactttacagacaagcaaatgctgagagattttgtcaccaccaggcctgccctaaaagagctcctgaaggaagtgctaaacatggaaaggaacaaccagtaccagccgctgcaaaatcatgccaaaatgtaaagaccatcgagaataggaagaaactgcatcaactaacgagcaaaatcaccagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgcagagacacacataggctcaaaataaagggatggagaaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccacaccaaatcaacagaatatactttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcaatcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagaggagaatcaaatagacacaataaaaaatgataaaggggatatcaccaccgatcccacagaaatacaaactaccatcagagaatactacaaacacctctatgcaaataaactagaaaatctagaagaaatggataaattccttgacacatacactctcccaagactaaaccaggaagaagttgaatctctgaatagaccaataacaggagctgaaattgtggcaataatcaatagtttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggaaaaaactggaagcattccctttgaaaactggcacaagacagggatgccctctctcactgctcctattcaacatagtgttggaagttctggccagggcaatcaggcaggagaaggaaataaagggtattcagttaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaatagagccctcagaaataacgccgcatacctacaactatctgatctttgacaaacctgagaaaaacaagcaatggggaaaggattccctatttaataaatggtgctgggaaaactggctagccatatgtagaaaactgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattggcaaatggtacctaattaaactaaagagcttctgcacagcaaaagaaactaccatcagagtgaacaggcaacctacaacatgggagaaaattttcgcaacgtactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacgtgaaaaaatgctcatcatcactggccatcagagaaatgcaaatcaaaaccactatgagataccatctcacaccagttagaatggcaatcattaaaaagtcaggaaacaacaggtgctggaaaggatgtggagaaataggaacacttttacactgttggtgggactgtaaactagttcaaccattgtggaagtcagtgtgacgattcctcagggatctagaactagaaataccatttgacccagccatcccattactgggtatatacccaagtgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtggggggaggggggaggggtagcattgggagatatacctaatgctagatgacgagttagtgggtgcagcgcaccagcatggcacatgtatacatatgtaactaacctgcacaatgtgcacatgtaccctaaaacttaaagtataataataaaaaaaaagacatatagtttaaaaagacaaaaaatttggattgagaatagacataatcttgatccagtaccttggaagtggccatctctatttcctcacttggtaagaaagcgagaaagacgagagaaggagaaagagaagcaaagagaatggggagaaggaagggagagagaaagaaagaaatcataaatcatagtattataaaaaatgacaaagattgcaaattatctactcaaatttcttttttctttcataacaggatgttaggtaatgttcccagctgaataaaatgacatttcatttctcaaaaaaaaaaaaaaaaaaaagaaaaaatgattcgtgaaaccagttaaagaatggtaaggcagactttattcatgtggactgtagtgatagacctaggtactaccacagtgaggttttgcagtaggcaaaaaggattgagcttaactctgaatacaacaaggaaaagtggagatttatagccgagcagcagtgggatggtcagtggatggaaaattactaagaggaaacatcaggggtcagatgggatcctggctaatctgacctaacaggattcttgctgaagataggccagggtgatcaaacatcacctgaggggtgatggaggttgaagaactcaataagatgttgagggtgatcagatattgaagatggggagttctggctaaaccaatgagcgggatacttgctaaaattgtacaacgcatagaagttcaagagtcaaggcctagttgggaagaggattcatcagagcccgactaaagttggattaaggagaggctctctgtcagttgttacttcttcaaagagatccttactgctctcccaagtacagattaggtacccctcttttgtgttctcacagcaccctgtatttccccttttaatagttattttctcattgttttctaaatataattacttacttgtctatcttcttgatttgactatggtgctggagggcacagactgtctttaacttgtttccctatggatttgcaagaggtctaacacaacaaatggatacactttctcttcagtgatctctaccttatgtctgcaggaaccagttgtttaatgggcagacactgggacagtggacaagaaacgtgtgtccaaaatgtcgtgctggacacgtgcagcccctctgaacaactcttaagagctattgctgatcttgtcccgcaaccctgatcgcaaaaactaaaaggcatctttgtaagtctccatgcatatactgctccattttcccagcctcctactgccaactcagtgagcgctgcatgtggatcacctttccttgcttcaaatcctccaaatacacaagaactgtggcagagcactgggaatgtttgccaactcctgagtttaggaagtctgatctgggctttgtcacaaaaggagaggggtgcggtagctctggggtgccaatcaattgcaagaggacagctaatgttcttgggagatgactggccccctaaggccatttgtcaagcaggatgattatgattaaatataactcaccagtctacaagtggccctcagacagcagaaagtatccagcaggacattgcatgtcacgaagcagcgccagggtagtggacatcaacagttctgtccaattaatccttggaagcacagtcagaattaattgggaacttgttgaaagttgatcgacacctttggaaaggtgaaatccttttctgttcccattaagtgttgttaaggccattagcagaaattggaatagagaaatatgacctttcatgtggtagattcagagactgagaagatggacgagatggaaatgtactggcagcttataataagcacctgggtggggagtgataactaaagattgaaaattgacaaatgggttaaactggcagagatcaagacagagagggatggggtgcagtttgcatgcagaggtggtgagagaaaggaatgagagcatcaataatccagcagggtcgcccatgctgagggtcagatatggattactcagaaggtaggcaaaatttgctaggtgggagagtagggagatttggttacaagatgaagagatcaatttatagctgttgagaggagtaaatgatctagtcctccccagggagttaggataccacagataaatactccagactaaaatcaggaggtctgagacatttgtttattcagttgcaaagtgactgaatgtctccaaccctccccttcccacagttggttatgtccttccaagtgactaacgtgaaatttctttgaaagccatcaagctatacagatgtaaggaattatcatcataatcatccaactgaatcaagtgcaaaagaatattgctataaggaaatatgtgagattttaattatttcctctgatggagtagaacatgtttgcagataatcttgaacagcaacagtgcccgaatgatttatcttgggctttacagccacacatcatgatattttgatggaggaaggtccggagttgtgggatgtgcatcaacatgcaattttccctgacattttgcattggctcagattatgaagccctgacagtgggaagaaatggaccaccagaaagtagttcttaaattaccaggagcgctgtttgctgcagagacactccagaatcttcaagttaggcgcagcacgtgagagttggcagttttccacccaccgacctgagttgctgtggttagatgagggctttcttgcaggatccaccagaggctgaggctttgggtcacagttatcattagaatgttgtctctttgccaggtcctatgctaagcattttacctgcaccatctcatttaatcatcaaaactactctgtggagttagatactattattgtcttcattttacagataagggaacaggattaaaaagattagtaacttatccaaggtcacatcactagcaaaagacaaaacttggtattaaactcaggcattagctccagagcctgtgcacggaactgccatacaatactgccatgcgcatatatgaataagcctgagaatctgagaaagaaggagatgtgacctacctaaggccactcaactagttagttgtcccatataccatttgtttttgttgttggaccagatctagtatgctcacagcaaatgaagaattttaaaatttccattttatagatgtagctcagttctagtaataatgatgatgacagtaacgacaacagcagtggcaactaatatttactaaacatctgtttttgctgagcaccgtaatagctactttatgtatacactcatttattcatttattgaaaaaatgtttattgagagccttctatacacaaacaagtgtgttcacacaaaagcttgtacacaagtcgtttacagcagtattgttcataatagcctaaaggtggaaaaattccaaatgtccatcaactaatgaatgaatacatgaaatctggtatattcatgcactagaatataatacagccataaaaagaatgaaatactgatacatgctacaacaaggatgaaccctgaaaacattatgctaagtgaaagaagtgagacacaaaaagccatatgtagtatgattcaatttatatgaaatatccagaataggcaaatttatatagagacaatgaatagattagtgatttccaggatctggggggaaggggcaatgggagtgattgctaatgggtaggggcttcttttcagatgtgacgaaaatgtcctaaaattgattgtggtgatggctacacgtttctgtgaatatactaaaatctattaaattttagactttaaaattgtgtggtatgtgaattatatatcaataaagctgctaaaaaaagagccatttcatatgtcatctcctttgtctagcctttcctgagatcctagacagggtagtcccttcttctgaattcctctatcaccatgtacacacctctgccatagcacttctacccctgtataaaattgtctacttacgtgaccttatacttggctctagaagctccccaaggtcaaggaacatgttttatctatttcctacctcttacaatgtttccctgtcctgcctccacccttttttcctcccttaatctctcttcccctcccttccttcttttttcaacccaaatttttgttgagcatctactgagtgcaaaggcactgtgctaggtatttgggactacagcagtgactaaagcatggtccttgtcctagtgcacttacagtctaataaggaagatagacattaaacgtacatgataagtgttagggaataaaattgtttaactgggaagtctgacctaatctgaggaattagggaagaaatctctcatgatgtgttattttacctgaaacttgaatgactagtacaaattagttgtgggggtagagaaacagcatagggaatgtattgaggctggaaaaagattgacaccatggaaaaagtgaagggagggcagtctggctgaaatggtagaaatgaaggtgtcaggggagtggagtaggtcatggctaacataagacttgagaggaaggtaaaggctttgttggccagactaaaggatttacactttgttccacagatggtttttaagtgtgtgtgtgtatttttcaaatgctcattgcagctgttcacttggagaatgtattggagagagcacaagtattacattagaataatccaggcaagtaacaatggtgagtagggtaactgcaaggggtgttgagaaatgtgaatgagaagggtttgggtcataatatcagaagacacaatcccaaaagccataatcccaatgttgaaatcttgaaagaccacaatctctgaagtctataaaatctcaaaaatcacattgccaaaagatcaaaatcctgaaaagataattctgggggaaataattttaaaattattttaaatacatttatttacattttaaagggtgatttatttgagaaacacatgaaatcatgacagaacacttcataggctggccactttacacaataaaatgggcaaaaataacgtgtatatttttgcaaacataaacattcaggtacactaacagtagtcacatgggtataaaagttatgagaagatgaaccgtattcataaagagatcaaaaagcaaaatacataaatgcatattactatagttagtaattgttttcacccagctttataactgtggtcttctgaaatactataagggacagcataagtcttgacaagatcattcaaaaactgccatgggtcaccaccgcatatagttacccaaaaagctgagatctcaagaaattttacctttcacaaatgcatatatacaaaaagggcatctcttcatttattgaggaagtttcaatgttttcacatacatacacaatgcttatacacaaagtcagggttgtgataatgcagttttgtggagtcaaatttgcaaaaaaaatgcatacaacacattaaaactctctaaaatctttacacaattatactttcagtattagaaatgatgcaaatatgaaatacatagtatggtgaattggcactgtgtgagaagggacacaagtcatacataattgaataatctgacaaagcagatttcttgtatttttttgcctgcattttcacttctacgatctctgaaacacttgttgcacttgtatttagagagtggttgtggcctatgcatttcctaagtatatgctgtccacttaaagtctgataattgctcagctgttgaaattattttctgcttttgcagcaccaatagtaattcgcttttaaacttttatctttcaccattaagtagccttgtatacttctcacggcctttttgcaaaggatcattttttttcaggtctcttctattgtgtcataaggagtacagtaagaaggaatgacatttagctcccccaatactaaatctgtattagtcagggttctccagagggacagaaccgatgggatacatatataaatacttgagagagaattcattaggggaactgacacccacatgtatctccttaaatcacacttaatttccaaataaagacaataacaaggtaatagttccacctaacatgatgcaagtatcctatatacaaccaaaaattcactaatctcttccctagaattcagctttcagggtttcagtatttggcattttaatctttcaggattataattttcaggcttttagatgttagggtttttagattttaggaattttgatcttttgggattccaacattcggaattatggcatttggaattgtgtccttcaggattatgacgatactgtgtaataggtacaatcaatcagtttagtgtttggtaggatatggggagtcagcaaggcctccagaaagattcctagatatctaggtggggcaactcggtgaaaatgatgccattaatttcaatagagaatacaggggaagaggtagggttgggagttatgtggaagtaaggttgtttttttgttttgtttttgatgtggtgacatggaggtacctattggcaattcaggtagagaggttcaacaagaatcagttgatgtatatggagtgcaggaaagatcatgtgtgagctggagttatagatttcagagttgttaacaagtaaatggtaattgaagccatggacctagcttattcatctttgtatttcccacagtacctggggtggtgtctgacacaaagtatttgttgaatatgaagtaagaagatgtcaaccataatccccttcaaagggatggtacatataggactccaggttggtgtgcacagcagatacacattaagagctaatgtttcttgagcccatactatgcatcagtcactttctaagcctcatgtcttaattgtctcagtaacactatggggtaagtattagcactatctctattgttcaaaaggggaaatggagacacgaggaggtcacacagcaagtggtagagttaggatttgaatccagacagtccgagtgtagaacctattattttaaccactgaggtatatttccactctagtacttgaggcctaagttattggtttgttaattggtcagtgtaggctgctgttcatggttgaaaattccttttcatgtctttctccttctctctgggtagcacttttatccctattctcctgacatttttgtgcttgcctcccaatccagcccattgttactgggataactagattatcacattcaaaggaatgaagttagaccttgcagtggtttgaatgtgtcccccaaaaagcatgtgttggaaacttaatccctaatgcaacaaaattgggaggtggagcctaatggaagatatttagatcatgagggtggagcccttatgaatggattaatgctaattataaaaggggttaaggctgtaagtttgatctcttgctttctctcgccttgtcctgctcttccactttctgtcatgggatgatacagcaagaaagcttttgccagatgtcagccccatgatcttggacttcctagctctcagatctgtgaggaaataaatttctattatttataaatgatctactttgtagtattctgttatagcagcacaaaatggaccaggacagacctctaccacacactatacataaaaattaactcaagataaattaaatgcttttatgcaacagctaaaaagataaaactcttaggagaaaacgtagatgtaatcatcattcttatgaatgtcaagtccattttccccagcaccatttgttgaaaggactattattttatttagttgtcttggcatccttgtcaaaagcttttcaaagtccctatgaatatctcactccctagttttaacttttaagatttttggtcactctattgtttgcctcaactgttactcaccatcttatgcagcagcagcgctaataaattgcttggaattgtttttgataaatgctcccaggtggaaggctttcacactgggagagtgctgaatcaggttaaatacagacaaccttacaagtggcatttcctgggaaccaccagacaggttgaataatgacaattctttgggaataattattggaaagagttccagctcctttcggctctctctggtgtctgtcaggatgttggttttcaccatgaatgcagattatgatttttcaagcctactgttgtgctagagtgtagggaattggactaggacaagtaaaaacaccacaatctcactcttcttactgagattcagccatttttcttgaataaatgcacctcagattgctggaaactcttggataatttctagagttctgaaaaatttgcttctgacaatttttgctagttttcccattacttttatggagaagaggagttttggagattcctactctgcaatttttcccctttactttttcaaacatggtttcctttagttctttaaacacatttctgatggcagctttagaatctttgtcaaatccaacatctgggcccactcacagattgtttctgttgcctgcttttgttccatacatatgattgactttcttctgtttctttagttgtctcctatttattttttgttgaaaattgggcattttaggtaacatcttgcagcaactagatattgatttcccttctctctctccgaggcttctttttgccattatttgcttgtttagtgacttgattaaactattttagtgaaatcaatttctccctcagtgtgaagtcttcagtgttgatcttcagagagcacagccttgggcacgtgcaccatcaccctaggatgccagtggttttattgcagctctctttctccatctctctgtcaagctatgtgcattgtttggaatcatacccagctgcgaagtttcactacttgctgggtgattgctttattgtttttgacaaagtcctgggatataaattgtttcacagataaatccaattaaatctaggacccttttcacagatagtacttgaggcaagtctttgaggtttgttcagatctcaggagggttcatctttgctgtctccttctctggttctctctggtgagctagtttgcctatgttttaagtggttgatcttaattaagagaattctcagcctcttcttaattgcttaccaccaaatatccattgtttttgaaagtgcccttaggtttgaacttctccagtctgtttcaaataaagttatttactttagggagagcttcagagctgtctgtccttatgacctgcctctgctgctgagccaaaatctgtgagccacaactccagagctgggtgcaaggacagtggcccacttttcttggaatgatattcatgctttatgacgaggctgtttggcaggggcagtagactcaggttttctcagcttggctctcccagaattgaacctctgccctatgagtgagatggggcaaggacaattagtgcctcagtattcttatcctttcatacctgggggtagagcctctgccctatgattgtgtctgggtggagaaaggaatacatcagcatttttcttggctacactcatctctgcaactcatggtgaagtggtggggggtgatgataaatactggtggcttgccctcctgtgagatattgagtcacttgaccgggagctgaagggagaggaagccttgtcatcttggccttatgtacccagaatgaagtttctttcatgcttagctggggaggggagatggaaggaatgggttatggctcaagtgcaacaaactcttactgttcttgtcaagatttagtagattttcttaaataaatatttcctcacttgcagtcttgccttaggacaattttgagagacttttaaatggttgttcgtttttaaaataacttttatcagttatacttgttttactcgcaagtgaatatcttcattgtcatatacttttttgatgcctgcttttctctatagcctgaggaagattctgaattccagaaaatcaccatttgcagttgtcaatgctataatacattgtgcctgtataatatcatccctagacaaagttcccaaatagatattaagttcttagaggagaaggactggatttaatacaaccatgacaccctgtatacttaatgggcccaaagaattcatctaaagaatgatgcacaaatagataactatagcttctatttaaaaatgacctcaacaatggagcataactcccaccccttaagtctaggcactgtgtagtaactttccattcattatggaaaggggagaaagagcaaccttacaatggacaaacttgacaaacattatctcaagctagttgatcaaggttaacaacaatagtgacatgttatattaatagtgtatactcgtgatatgatgtgaatgagaatgtcgcttgacctctgaggtcctcctgccaaaaacacattaccccagtttggtcatgaaaaaaatatcagacaagtctcaattgagggacattctgcaaaatacctaaccatcactactcaaaacttgtaaggtcatcaaaaacaagaagtgactaaaaaaaccatcacagccaagaggaacttaaggagatattatggtcaaatgtgatgtggtatcctggattggatcctggaactgaaaaaggacagtaggtaaaaactaaggaaatataaattaagcatggactttagttaattataatgcattattaatatcagttcactaattatgacaaatgtaccatactaatgtaagatgttaataataggggaaacaggatgttgggtatatgggagctccttatactatcttaccagcttttaccaaaaacagttctagaataaaaatagtttatttggaaaaaccaaaaacaaaacaacaaacctctactacaatgaggcaggctttgtgctgagcagaaaaatactcagtcgacctgagagtctgtttttcttgagatcccttgtggagtggggcccatggagacccagagaaaaaggtagctagggtagaatcagaactctgtgtttttttggcccaatagtttctttcctatgaatctctcttaaggaaacagccagatgaatacacaaaaatgtccatgccaagtatggttactgcagagtgaaatactgcaacatcctaaatgtccacactggggcggtatctcactatgtttgttctatagagcatcagtccaataaaatgctccgcatatacaaacaggaaacgctgcgtgctatattcccgtcgagagtccaatatacattagtgtaataaggctctgagatgagtcatgctaaaaaaaatgtaaagttctgttagaaacagggtttgaaactcacaactatggatcattttttatactttttttttttttaaacaaacgctactaatgtcttcacactttgtaaattgttacactaaaggttgggttatatagattatgaaatatgtttctattggaatattatatagcaattagtgaaatcatacttttataggactaatgaattgagaaaagtcacaattttaaataaggaaaacgagatacacatttgtatatacaatataatcttaattatttaatgttttctgtacataagaaaaggacaattaaaaactacaaatggttatcgctgggttgtgtagttacaggtgattttaaatttcttctttatagtcctttaatttcatagtggtctacaaagtaaatatattatttaaataatcagaaaagaaaacacatcataaagcaatattttgtaagctaaatcattcctacccctcatgcactctaaacttatttgctttttgttataaaaaagtatttgtcagaatttttttgaaaaagccagattatataagctcgggaaagggaacggcagaatgtcttagatgggcttgatttaactagtggagcattataaaaatagagcatttctctcttatggccagcaaggagatggccacagtaacctgaaggaacgagcagtccaggctgctaaactgttgctattttttggctaatgctggactgtgatgcccttctttggctaaagctgtactgtaccatctgagatggcatttccttacagataaatgttcttcttcttgattaaggaatgaacacacaaggcttcagcctaattccccatgtcaaaatgacctccagaggacagatacttcatcttcttgtttgtgtgcaggaattcctttcaggttcctcctatgagactcctacactaatgcaaaaatttctgctctttctcaggtggctggaaggggaagggctgagctggccactttcagtgcctctctgtgcagaaactctgtggcacttaccaatgtctggctggcctgggattgagcactagcatgtgcagggtaggaattgctggataaataacctgaaatgcattttcgggtaatcagtttcattcgtagaaactgcattcagccaatttgcaatgttatatgatatcatatgatatggtatgacatgtctgagaataaagtgcaagatgctggagaatgagggaagctcagtaataatcctagttttgctaccaattctttgtgtgatctttgaccattgcttcccctcactgggcctcagttccgccaaatataaaacaagtggtcggtctatgaaattggtttcctgattcagctataataaaacttaaactcctttacatgaaccccagggccttgcatgatcaggcctcttgtctccctctttgccttcatcacccactagtttctcccttacactattccaaccatacctcaggacctttgcactatctctttcctctgcctggaagactatctcccaatatctgtctctggttttgtacctgggtgttagctaaatgtcacctcctaataaaggccttccctgactagctgctatagttatggattgtttgtccccaccaaaactcacattgaaatttgatacccaaagaggcagagttgagaggtggggcctagagggaggtgtgtgggtcgtggcggcagatctctcatgaatggcttagtgttgttttcacagtagtgagtgagttcttgctcttgcaagactgtattagttcccacaggaatggattagtttccccaagagtggattgttgtaaagcctggatgcccttcaggttttccctctcatgtctgcttcccctttgaccttcccaaccatgttatgacatagcatgcaaggtattgctagaagccagggtcatgcctttgaactacccagcctgcagaactgtgagataactgaacctcttttctttataaattacccaatctaaggtattatggtacagtaacgctaaatggactaagacaccaccttatggaatggtgccctgtgccttttcccccattactctctttcctattaccttgtttcatttccttcctggaaatcattactttaatatttgtcttatttattttattgctggcctatttactgtttgtcttcccccactagactctgtagggaatcttgttgattttattcatttctacatcctttctgactagaaagatgactggcacagagtaggtaattgatagatctatgtggaatgattgaggaggcacctgacatttgcttacttaacaaacactctgtgccaatctttctatactgctttgcaaatttcaatttatttaattttcataacattcctatatatgaggtagacactactatttttcccactttagagataaggaaactgaggcagagagaagctaagtaatttgcccacggttatactgtagtttacattaattgtgtcttctaatcctaccaacaatcctacaaagtacatattatttttacttcattttatagacaagaaaaccaagacttagaaaagtgaagcaactgggtaggtgacaaagaagttgcttgaatccagagtgtctgactccagaacgctgcttactcaagactgtcacataactgacctatgtgatctttcttttttaaaatatgtttttatttcaataacttttgtggcacaagtggttttgggttgcaagaatgagttatatagtggtgaattgtgagattttagtgcactcgtcacccaagtagcgtacattgtacccaatatgtggttttttatcttcgcccccactctcccccttctgagtctccaaagtccattataccactctgtgtgcctttatgtatccatagcttagctcctacttataagtgagaacatgcggtaactggctttctattcctaagttacttcacttagaataatggcctccagttccatccaagttgctacaaaagacattacttttgttcctttctaaggctgagtagtattccatggtgtatatataccacattttctttatccactcaatgattgataggcacttaggttggttccatatctttgcaattgtgaattaggctgcaataaatatacatgtgcaggtgtctttctatacaaggcctgaaggttagataaggcagatattgggtccacagaggtcatgtagcagacagagctgtattgagttgagaggctggttttcagggaaactgtggttatgggagggggagcccttttgcccacctcacccagagtacatgctggagtgggctgggcctctttccaaagctggctacatcctgcctcccactggagacagttccgttaaggggccaggccaaagggacgttgctagggccgaaggagcctaagtcccagaaagaattgttgagacaccctgaaaccttctctgctccagggacaaccatgaccactctcagcttgtacatccagctggagaaacatcatagaggcctaggaaaggtacaggagagatccagaggtaaggccaatggctgggattgcagtgtgtctgctctagacacactgacaaactagaatcattggccactctggaaaaacttataactgcacagataacaaaaagataactccacccactgagcagacccatggactggtctggatggtcaggctagaccctggccagcccaaacaagccacatagtctagagaatgtattttctatctgtttatcttcccttttcccccattgttctgcacaggaccaccacactgcataaatccagagtatgtcatttcatttcatagtatatgtaaatactgcccctggagttgtgagtaatgtgtatggtggttctggtgctacagttcacttgtgtgtctttctgtgagtccattcttatttatcatgttcagctacagtggctacctccctcaaaccagtggtgtgcagtggcaaatgggcatatgaaaagttgctcaacatcagctgggtgtggtggctcacgcctgtaatcccagcactttgggaggacgaggcaggcagatcacttgaggtcaggagtttgagaccagcctcgccaacatggcgaaaccgcatctctactgaaaatacaaaaattagcctgccacggtggcaggcgcctgtgaacccagctacttgggaggctgaggcaggagaatcgcttgaactcgggaggcagaggttgcagtgagccaagatcggaccactgctcaacatcattgatcactggagcaatggaaatcaaaactacaatgagatgtcatctcaccccagttaaaatggcttatatccaaaagacaggcagtaacaaatgctgacgaggatgtggataaaacggaacctttgtacactgttggtgggaatgaaaattagcacagccactgtgtagaacagtttggaggttcctcagaaaactaagcctagagcgacaatatgattcagcaatcccactgctgggtatgcacccaaaagaaaggaattcagtatattgaagagatatctgcactcctatgtttgttgcagcactgtttacagtagctaatatttggaagcaacctaagtgtccatcaacaatgaatggataaagaaaatgtggcacatatacacaataaagtactattcagccataaaaaaaatgagatcctatcatttgcaacaacatgggtagaactagagatcataatgttaagtgaaataagccaaacacagaaagacaaacatcacatgttctcacttatttgtgggatctaaaaatcaaaacaatggaactcatggaaagagtagaaggatggttaacagaggctgcaaagggtagtgagagggtggagggaggtggggatggttaataagtacaaaaaatagaaagaatcaataagacctactattggattgcacaacagggcaactatagtcaataataactgtacatttttaaataacggaaagagtgtaattggattgtttgtaactcaaaggataaatgcttgaggggatggataccccattctccatgatgtgcttatttcacattgcatgcctgtatcacaacatctcatgcaccccataaatatgtacacccacaaaaattaaaaatgaaaacatttaaaagtggtctctaatatttagctaggttgaataatgaggctttttttctgtattttttcagccaatatgtgtgccaagcatccagtgatcatgagaaaatgaagccttttaatttataaatgttgatactgacagattgtagttatgagactgtaagcctttctgatcatttattttcttattgtttgaaaaattaatcacagaacttccctattaggtgtactgttgagtatgtttattggaaaattaataagtgcataaagacatttatagccttgtgtgtgtttctgagtctaccacaggtgcagaagttttacagaaattgctttctcatttccaaatccatcttttgtcatggagagactgctctttcaggaatctgatcgctcagaagtttgatcatcaggctcactagggattgcatctgaaaagaataagattgttaattgtatttacaatgaaatgtctaaataaataaagaaagccctttaacatttgattaataactattaagatctgctgaaacaggatgttatgctggatgcagctggttatgaatcacagcagtgcaagagtgttttatacatattatctcttattttcccaatgcccctgaaaggaaggagtgatgatttccattcacagatgagaaaccaaaggatcagaggaaggaagtgacttgcctaagatcccagagttggtaagtagtagagccagcagttaaatatttctggtacacgtcgatttcataaccttaaagaccatataaacccaaattagaatgctgtgctagaatagatacaaaattatctttaattcaaattcttctgatttgtgggtggcatttctaaactttctttactttcctgtcctagagataccaggacagaggggagtcccagagagtagcccttaacattttgagacactagggcatccagaacttgctgaagatgagaggcagagtgagaggggaaggtggcacagggataggtgctgagccagtgtggaagacccctggaacacaacaggacatattgatattaccgccagctgttcatcaacagctgttcatcagagaagggagtcctgtggcttggtgcttttcttgggcagaactgacttgggctttgacttctgttcttccttcaaatttccctgtagaaatagacttgggtctaagtcttagctctgccatcccctctggctgtggaatctcaaacaagtcaaccactctgacctttagttccttgtctgggttgatgtgaagattaagctagcatctagtacagtgcctcgctcacactaagctctccataatgaatatacttcttattcctattgtgctctcacatttccaccccagacaccccaacacttttctcagcgttcattttccacttgaaatgagcatggagccctgaggaatgtctgtgtgtcttccagatggtgctagcccccactcccatccctactgccttcaggtttcagggcagcatgtctgtgtagatctgtatcttgctctattttaccaggtctaggcctgcctgtctctttgctttgatccctccatacacacgcatatacctatactatgcccaggtcaaagtggcattgacatggaaaagagtgaagaccctatctcaaccagactagaatcctgaccctgacttaaacactgacacagcccctaacctaaaaaaggggaaggatttcattgaaggaccaaaggaaagatatacaaaagtctactttagagatctcctgccctacttcatacctgtaccatgtctcaacctgttggtatagcatttttatcactgccaaagtgtacaaagtctcagttataaaatgaataaattctgggaactgaatatgcagcatgattatgatagttaacaatactgtatttgtatacttgaaatttgctgagagaggtgatcgtaaatgctctcgccacacaaaaaaaggtaactttgtgaggtaatgaatgtgttaaccaatttgattatagtaatcattttgcaatatgcagtcagcccttcattatctgtgggttccttatctatggattcagtcaaaccaggatttaaaatattttttaaaaaatatatggttgcagctgtactaaacatgtacagactttttgtcttgtcattattccctaaacaatgtggtataacaactatttatgtagcatttatgctggattaggtattacaagtaatctggagatgatttaaagtatccaccaggatgttcataggttatatgcaaataccacaccattttataacagggacttcggcattcatgaattttagtatccacggggagtcatgaattttggtaaccatagggagtcttggagccaatcccccatggacactgagggacaagtgtatatgtacatcaaatcctcatgttctgtaccttaaatttatacatctttatttgtcaattatatataaaactggggggaaaagcatcaactctggaatcagacaaataccagttcaaagcctggcttggctgttcatctgtgtgactctgggcacattttttaacttctctgagtctcaagtggcttgccagttaatggaaataatacttagccctagttcattcatctattcaacaatgtttatcaagcccctgactacatgacaggcactgtgctaggcattgggaatatgatgatgagaggggagataaacatgaataagaacacccataaatgtaaaattgcgactgttcaaagtagtgacaaaggtacatggtattatgagctggtatctgacctaaacagagaagtaaaattgacaggacttgcttggtgatggattgaacttggaagacaagctggaggaaggagtcaggaaccattctttgctttctggatggcaacaggtgccattcaccaggaccagcagcagtggaacagggccaggtttggggaatagttatggctggtgggggatacacatgtgtgtattgactaaaagtccttactaggcgtcagggacagtttcctatttgtctcatttaattaaatcatgatggcagcttcattaggagaatgactattcgcattttccaggagtggaaacagactcagaggattgaagtgacttgtcttggatcttacagctagttagtggcagatccgggactaactttcattctgtagcccaaacacatgctttttccaatacttcaccctatgggacccagcaaagcctgcaggggaagggaaggctggcaggccaagggcagggactccaagaaggcagaaagggtggtgggagtagaatgaaggaaaggggaacagaaggaaaaagaactgtggcaaaggcaggaggaattctctacagtgacttaagatttattatttggagacaggttgagcaggccaaactgaggttcatatttcacaggcctactgccgcctcctaccaaattttggctctgaaccctgaggaggtggcggggagggaaacaaatgaggaggcagtttatgaagtggcttaaggcccagggctaaatttgaaattaacatggagatttcagtcagaggagtcaagtttccagggccgtggctatgcccagcagctggggccccaggagggatagaaagctgaccattcctggctagtgctttggccccaaccttcctgtcacctgctccatgctcctggcgttctaggaagcaatgagagtcactcttttagcttgtggcttctcctgccatcagaagcaggcttctgggcaccgatgtaggacaaggacaaagggagctgggtgtgagaaagggctgggaagtaggtttaggcagatggagctgatgtctgccttcctcctccagttgttgcttggcttccccaaaccaatgtcctcctcacctgagcttcttacttagccctgttctagtttctttcctttggggcctgcctgagatagatacaagcacaaaggcaggggatcaccaatataacttcacggggtatacatcatcacctcagtattagggttcctatatcctttctgggtgatacattaggaatctactaagccagagtttcctctgggttctgacaacctgtgggagtatgggatattcttagaggttcgagagttttctgtgataattttaaaattgtgggatgtttttcctgtggttttctcttggatatatttaaggtatacaacgcgatgttttgacatacatctacatagtgcaattgttactattgtgaagcaaattaacatatctaatatttcacagtttttttgtagcaagaatacctaaaatctactttgttagcaaatttccagtatacaatacaatattactaactgtagtcctcatgctatacattagcttgctagactccttcatcctacataactgcaactttgtgccctctaacctacatctcccaatctcctctctctgctgcccatggtaactagtgttctactctatttctatatattcagcttttttttgatcccacatataagtgcaatcatgcagtatttttatatctgtttctggcccatttcacttagcataatgtcctccaggttcatccatgttgttccaaatgacagtatctccttattttttaaggctgaataatattccattatatatatacacacacacacacacacacacacacacacacacacacacacgcacacacacacacacaccccagaattttttttccttttttgagttataattatgtttaacttttattttaagttcacgggtacatgtgcaggttctttacagaggtaaacttgtgtcatgggggtttgggagtttgttgtacagattattttgtcacccagttgttaagcctgatacccattagttatttttctgatcctctccctcctccaactctctaccctctgataggccccagtgtgtgttgttcccctctatgtgtctatgtgttctcatcatttagctcccaattataagtgagaacatgcagtatttggtttgctgttccaatgtctttatttatctattgatggtcacttaggttgattccatatcttggctattgtcaataatgctgcaaagaacataggagtgcagatatctcttcaatatacacatttcacttactttgggtatatacccagtagtgggattgctggatcatatggtagttctattttcaatttttttgaggaatgcctgtacttccataatggctgcaccagttaaaattgtgtttttatcacaattaaagtctaaaccgaatgatataagcctattctgtatcatccatctgcaaggccaccttatagctaaagggcaaccataggatttctggactctcatttacatctgcctccatgtattaggatcagattaggctgcatgtaacagaaaaaaatccaaaataatactggtataaacaagatagaagatgaattctgcatcatgtccaaaaagttcaaagataagctgtgcaggtttggtgtggcagctccatgttgttaggtaccacatatcctcccagatctccactatgctgttctgaagccatggccgtcattctcgtgatgcaagctgatagccatagctccaactaatacttgctcattccaagcagtaagatgggggaaagggcaaggaaggaccagcccccttcccttttagaagatccccaagaaatcaccaataacacttccacttgtatctcattgaccagaacttggtggtatggctacaatggaggccatggaatatagtatgtgttttagttgagcacattaggagagaaaggggtgagtagtgggatggataactagcaatctctgccacatttttgtgtaaaagaactcattaccttcacaatgtcctacttgcattgtcaaggactaatgaggaaagaacataggaggacttaatacataaatgatggcttagtcccagtgaaggccaaatgatgtccctcagggctacaggaatgacaggttagcaatagatctgatggggaaaaaagtggtgcgagagctgagtcattgcctggctcacagtaatatagcacgacgaactcaaaagaacctgtattgcagtcagcaccatagtcacgatctgaacagcaatttaattttagcaaaacaacatcatccaccttgttaaaaagaactgttgttcatttgatttttattggttttgtggttttgtttacatttcatttggaactttgtttcagctttataattgtatatcagccataagcatagggagttagcagcttattttctctttgtacccagtttaacaccgtaatgaagatgactcaataattgcgatccatatatatatatatatatatatatatatatatatatatatatttcttttgaaaggggctggctactcagctgggaaatgcttcctgaaaccactggggaccactgtaacaaacaggactgtaggagttagaacccaaactaaggcggggttcttttcacaccaccaccccagtgctggtgaggaggaggtagaattgtgctgcaaaacaggtgttgaacctagacgtagcatatgatcagaggagtctaacattggaagtgctcataaaagtcacatggcatgcctcctgatggaagcttgagcctctctataagccaagtgcctgggtcagtgggtgaggatgaggttggtggtttaagatgacataatggaacattttgaggggaaggatgattcaagcattatgtccctgacaaccaagattccttgggatagtttttgagtatattcatgtgaacatttgataagcagaaaggatcctggggtcaaatatatgaaaatgtataccctcccttggtaacctcattccacttccctgaccatctgccaccgcccaacttggcctggatgatgcccatccaggctctttcactgcattgcaacctagagggcagcctgtttatcatgggggagaggggctgcaagggatggtagggcctcttttgacactggggagttggggtgtgggaggtgtttccaaaagacttgtttcaggccacttatagatgcagggaaggaaagctctttctctctccttctgtggcagcagtaaatcttcctagccccagccactgccaccatcctcaagcactttcttggattctccacctgttgtgagggaattccacagggctcaagatatcctgaaaaccaaataccacatgttctcacttataagtgggagctaaacattggatgcacatggacataaagatggcaacagtagacactaggactactagaggtgggagagagggaggggagcaagggctgcaaaactattgggtactatgcccactacctaggtgatgggttcaatcaaaccccaaacctcagcatcacgtaatatgcccatgtaacaaagctccacaggtacccactgaatctaaagtaaatgttggaagaaaaagaaattttgagaaaggctcttctatcaggatgaaagaagaatcagtgaggggggcatacgatatagagagcaagacagactaaaagagaaagttatttatagaaaaagatggcatatgtgcatacatatatacatgtatatatacacatatgtacacatatacatatatacacatatgtacatatatacatatatacacatatatgtacatatatacacatatacacacatacatatacacacatatacactatatgtgtgtatatgtatatatacagatatacgtatatatacgtatatctgtatatatacatatatgtatatctgtatatatacatatatagtgtatatgtgtgtgtgtatatatatatatatatagatatgcagagatagagatggagagaaggggagatatttattaagagagaaatggagaaacatgaaaaaaagaaccaaagagaaagaagtggaaggggagaaaagaggagagagaataaagagtaagagaaaaaatttaaaagacacatttaaatgtatagaaaagtcaagtacaaggcaagaaagggctttaggcctctgtgttgcctcaagtatcaggaaaaaggatgacaggaggaaatgctgtcatcgagtctgtgctatgcctactgcatggggagaacttcaccagcctgatgctctctccaggaagcttccagtccaaaaggacctgtcgatgagccactgaatttacaggcagcaggacagtggaagagaagaattcataacaagccacagcatacacagtatctggaagagctcagaaaagggccaaagttaactttgagacaaggtggttggaaagaatagccagtacatgtacagacaatgtctgtcatttggagaatccacgctgtgactaaaccaaggaagagtttctagagcagaaggtaatttctagggctgtgggaatgggatgttaggccactggggtgggccaacagccacgcacaatcaaccatgcggaaattcttgctgaagactgattcccagatttctccagcctcctgcccacccctactccctcagactcagtagctggcctctcttctttcacagagaacgtgaaagctatcaggtggaccaccacccccggcaccctctactcacacttacttctccttttttttaaaattcacaaataataatagtatatgtaatacatatggggtacaatatgatgtgatgatacatgtatatattgtagaatgattaagtcaaactaatttttcataatatggaaacaatctaagtgcccatgaatgaataaatggattaaaaaatgtcacacacacacacacacacacacacacacgagtatttttcagtcaaaaaataaggaaatcttgtcactcgcaacaacgtggatgaacgtgaaggacattatgctaagtgaaataagccaggcacagaaagacaaaaccacatgattttacttatatgtggaatctaaaaaagttgaactcatagaagtagagagtagaatgggagctaccaggggctggagtagggggtggacagggaaagggaagatgtgaataagagggtacaaagtttcaattagacaggaggaagaagaagttctagtgatctactgcacagcatgctcactatagttagtaatcatgtattatacatttcaaaattgctgaaagagtggattttaagtgttctcaccataaagaaaggataagtatgtgaggtgatggatgtgttaattagcctgacttaatcattctacatctccttttattatttctcttttccctccgggctctacacactgtcccctagccattctttattcaccattacatgctgaatattccagacttagatggcgtagtctctgaaaagggtgtattaacacatgccataccattttatccccagagcaattttctgagttgggtatcataataccaattttaaagatgaagaaactgaaactcagagaggttaggcaacttagccaagatcacacagcaaggctgaggtttaaacttagacatcccaggctactcagcccattctccttcactgtgccagacaggatcccaggtacactgaagaaaatacttgataaatgaaattctacccatttgggacctactagagccagggtgagggggctgcacaatgcagttctgaggaaataatctttgtgggaacaagattaaaatgtcaggctgatgtgcccactggctgagctatcagaagtgaggagagaacaagcaataaaaattaatagtgcaaggacaagttaatttaaaaacccctgcacatgtatctggaaatattgcacgtcatcacttcctctcataaccgcacaattgtcgagcttggcaggcaagtagctggatctacacctgacacggccccttccagtcctttcaccagggcacagcgcatctgcaggtacagttgaggggtcagtgaaaatttttttctgagacctgttcacccctcttctgggttccccgctcattggtgaccaccccagctctgtgcccaaccatcagctgccagtcaccccatctctactctggttgagtccagttgaggtgtagtatcttctggatacatttatctccaataggaagcatctgggcaacttaactgagggtatgagtctgtactcatggaattttaggcaccactgaagagaggctttgcggtaaagaggatttgttggccttcctgctccttgatttctcacctgcatggtggagctgtcagcttacttaacatgccagccactggactagatcaaatatatatctatatgattataggtgatctcattttatgctcagtgcagtcttgtgaggtatattgttactatttgacacatgataaaactgaagctcagaaaagctaagtaacttgcccaaggtcacagagcaggtaagtggcagagctggaatttgaacccaggtagtctggctgtagagaccacactcatagcaattatccccacggcttccctacaaacaaacgaaacaaaaacaacaatgaaactgaatggaaaagcatgctgtttctgtcccaccaccgaagagatatgaaaatcctggttcaatggcccatggagatcccaacctaaggctacttccttcctaatgacagcatatctgaactgcaaagtaccatggaacatgtatgttattatacttctagaaagctggcttgggaataccaaagtgggattctaacctaggttttcctgacctctaatctcattattttgaacctttagactagctccacttttcacactgggagccctgataggacacaagtgggtactgggagataaacctgggctatggtcagagtttttgcacattagataatattttccattgtgaacatgttttcaatatatgcacatactcatagtcttttgtattcctttttggattatttctgtatccttgtaggttaaaaataatggccaataggcatcaagctcttactctgtgctacgcactgtgttcactgctttatacggatgatcttttactcctccacaatcctatgaggtaggtactattattaactccattgtacaggtgatgcaacagagactccgggaggttgaacgactacctcaaagttacacagctactaagtggcaaagctgggatttgccccttggcctgtgtgactccagatctgaggctgctatccactcctcagggcagaatttttggagcagctaaatgaggtttttattaaataatagagagatctgtctagcaactgttccattgcaaagatgggagaattgatgctgagaaatatccaatgaatggctgaaatcacagcctgtcggggagttgagcagtgacttgaagcctccacagttcttgtccaatcctcagatactgtgaagtctttgaggacagggctgggtctgatccacttatctccccagtgtctagcacataatagggattcagttaatacatttttggcaatgaaacgaatgtttctaatgataatttttcatctggcctgacttcaatcttctcttaatgccaagtcttgccgtgttctaggtcgacaccaacctccctctaacaaatatggaatatagatgagggtctgagccatctgtgctcttttgtttgatttaaggtcattggtggcttcaccatccagatttcaccactggcatctcatacattcatttcttgccattccacttcttacagaagaaaacatatgaagggatagtcatagtaatgaggaagccaaggctatagctaccaaaacaaaaacccaggaaacaaactcacgtaataaaaatagcacctccagcacaccaacatggcacatgtatacctatgtaacaaacctgtacattgtgcacatgtaccctagaacttaaagtataataaaaatatatatatataataaaaataaaaatagcacctcatgggtactgaggactttccatatatgaggcactcttctaagacatttgtatgtactaattcatttaatcctcacagtaatctaatgagatagataagattattatccctatttaacagatgaggaaactgagactcagagaagactggctacggagttaataagtggtagaattagaaagttcactatgtttgaccatgcttgactccagtgtctctgttattaaccataatgctaaactacttacacttattaccaggggacttgttgatggttaggctatggggactgagccaaggaaggggcaataacaattcctaggacagggcttgtgtttgatgagagtgggggtggtcatgagtttggcttttgaatatatcaagtttgaggtgtctttgagatacccagctggagatgcaaagaagacaggtggatatgtagtctgaaatccagaggagacattggggactcttcaccatatagataaaaataactgacatttattacacactcactaagtgccggcactgtcccaagagatttatgtggatgaacgattctaatttaattcccatggcagctctatgaaattggtgctttattatcctcattttaaggataaggaaactaagatacagagaggataatgatttacccagggtcatataactggtaaattctagaggcaggattcaaacccaggcagtctgaatcatctgaggttcagcttccttaattgtaaaatggaaaaaataatttccagcatgcgaggttgttaagaagattatatatgtcaaaaccctggcacatagtaagaattccacaaattagagctgctaccattaatgcatctaatattatgtaatacttatgattgatacacaattacacagttactatcgtaacaggtaggacctaagtgttttctcatcaggatctcctttatttccattttctcagtttccctgagaaaatgagcctgatctcttggcgctacaatgagtatagatactattagtaactatctcagaaagattctgaagaactaatgggccaatgtttgtaaagaatttaacacagtgcctggcacctggtacatgctcaaaaaatattagctatttctgagcctttgtcctggccacaaactgaatgaagtcacacactgagctccaaattccagctactgactatctttcaactttcttttaacatctttcattttaaagcacattagatgccccagctgaacttgtcttcagttcagctcactttaagtcctttttctcagtacttttgtggcaactttgtcctttccactggcaagccctcctgggactacaagcacactaggccccaccaaccacactggacccaaccacgcactgagaatccataaagaaaaaaaaaaaaatcttcaaaatctctgatttacttggtgccaccactctacccacaagggggcgctacctaatatataatccttacgtttttgctgcagagatgaatcaaaacctaagacagtggcagaatatgaaatccatgtaaacagacccccaaatttgtctggagaccaaacccctaatgttggccacagcctgcgacttgtagcctagcctcgagatgagtcgtattctgcggaccgtacagcctaatggttaaggccatggcttctggagtcaacctgcttattttctgattctggctctatcatttcctagctgtgtgcactctgagcctgagattttaactggaaaagagggatactattagcaactatctcaggaagatcctaaggagcaaacaggtccatgtttgtaaagagttcaacacagtgcctggcacctgttacatgctcaaaaaatgttagctctttctgagcccacatcctggccaccaactgaatgaggtcacacactgagctccaaattctagctactgactgtctttcaactggctatctcatacagcacggtcctgggatggtggctggtggttccatgaacctgcattcccactaagggtgacacaatttgaggttctctgatgcctctctcccatgtccaccctggccagcttcctgccatgtgcacccttatgcattcaggccaaggcttcaggtcagtgtgctaattttggatttcagctcccctgctggccttggccttggaggcaggcttagattacatgttcctgccctggagagcaaacctatcctccccaaacaaacaggtacatgtacgccacacagtgaaacagacacacaaacattctgtctcacacacacacacatatacacacatacacactctttcacccaaactccaggagcaaatccctgcccagcggggagggagtgaaaggtaactgagccctgaaagacagctgggcagccagctcagcctctgccaggcacttttcctagtaagggcatcctttgggcgacaatatccaattgaagacacagccgatagggagctccatgactgtttcccttagccctgctagcaatgtccccagaacctttttgggttctgtatttagagagctgctggtactcaatgacccggtcagccggcagctggtgcctgcctgcctgcctcttctctctcttcctctcccaatggctgtatctgtgcccatagagataagtgattcgaattcctccagtttgtggtcttccttagtgctgagtgtggcccaggagtgccctttcccagtgtcgtttgtaagttttgaccctgcatgcttcaatccctcccttgccatttcagttttttccccaaagggctggatgaattctagcttctccagctggaggaatgtgtggataagtcctccagggtcccatcagtttatgaagatgggcttcccctgggtatgattccaaaacacccgtggattcatttcacaaatatttaatgagtccctattatgtgtcaaacattgttctcagtgtaagatacatagtttaaaaaaaaatgaaagaattctcaaaggagctcaagaataagtgggctaacatgccagtatgtgcttactacatgttaggcactgttctgaatgttttaccatctattaacttcaaaaccatttgttggtcttcaaaacctcatgatataaggaatattattatgcccattttacagacgaggaagctaaggatcagagaggtttcatcactgtagtaatttgaatagcatcctccagattcacatccatccagaacctcagaatgtaaccttatttgtaaaaaaaaagcctttgcagacataattgttaagaattttgagatgaaatcatcttggatttggggtgggtcctcagttcaatggctggtgtccttttaagaagaggagaggacatcacacagagacacagagaagaaggcgatgtgatgattgaggcataggttggaatgatgtgtctattagtcagggatcaccaaagactgccgacaatcattagaagctaggagagaggcataagacagtttctccctcagagcctccagaaggaaccaaccctgcagatcccatgaactgtgagagaacacatttctgttgttttaagccatccggtttgtggtactttgttacaccagccgcaggaaacaaatgcagtgacttacagagctaagatttgaacttcaacaatcagcctcctgattctgtactctcaacccctcctgcctactatgcctcactctcaggtagggaaggtggttagggggcctccactgaagaagctagaaaagtaatgcccatggtgaccccagatgagtaatagcctggccccttctaaacctcaattttctcatctgtaccatcaggaattggggctagatggtctttaaggcctcttccagttgtggcatttttatgagtctatgattcatagttttgggggagaggtggcacagtggcagtcatgagagcaggttgtggacgaggggatagagaatacacattatatgtaattgactgattttcaaaaggcctgtggataaaaccctattatggaaaatttttcattatctttccctgttgttctctttatgtctgtttctctctgactcccccgccttgcctgtcttgcacatgcatatgcatccccacacccacacacatgcccagagactcctctccaatcctggagagtaagttcatatttatgaatttcaaactggtgcaaagggaaggggccagtgtatgagtgtccaacagttcctggcaaggggaaaggcattgtggggaggggtggggagggctctagagatttggggctggaaacagtgttattaagtatgttcattaatgagcctaagaaggaaatgactaatacattgatggaaggaggctgatggcaccaaaccacttggttaattaaaaccacagaggtcttagagtgactctgaaaagcccctgaggatggaagtggtcgatagaaggaaaataataaaaccaagaaagaccattcgggggtaatcattgaaggaatgtcttgcacagagaggtatctaagactgggaaaagagaaaaaggacaaaacatcacaattctactcccctgggagcactaaaagctccctagcacttgcttgtttttttacaaatgttgtgatgcctgaacatagctgtttgcctagcagccactgagaaagggtctgggccaaggtccagagcaaatgagaggagctatggcaccccatgaaagcctctaaatattggtcaggtggaagggcatctgagggtcttttccattgtcaacagccaagtggcagagagtctcccaggctagatatagctttctctagattagctcccagaaggtgtttcaaatgaaatgacaggaaatgactttgcaaattgccacagcaataatttaggttctgggtggtcatttgtggagcaatgattgctacctcacaacttgtatacaaagacgtttgccgtagagactgtccttaaggctttatctcttggaagagtggtaaagtacaaacacttagaagtctgaaattagactagactcagcaagctgcccaaccttggtttcttcacccataaaatgggaataattatagtgtctactcatagggttgttttaaggatcaagttagaaaacacagaaaatgtactatgcttggcatataagaaatacatagcagcctttgtcatttctacctagatgtctttcatgtacctcaaatttgacataactcattacttcctcaccctatgtcccttatctcagttaatggcatcaccatttactcagtttcttaaactataaatttcagaatcatcctcagtctccctgttttccttcaacccccacattcaattgaccaccaaggcctagttcctcttcttgatccctcttgccccacgttgcctccacctagtacagatcctcatcatttcttgcctgaatgactgcaacagtctcctaactggtttctatgctaccatctctcccctctgcagcccattatccacagtgtgcccagataagcttttaaaaatatgagtctgattagggaactgtgccttagcttaaaactttttcaggactcccgctttccttaaagattaagtccactttccctattttttcccacaaggaaattcacattctcttcctgtccagcctcctgtctactcctcatatatttgagcctctttgaatctcttttccaaatatgccatgctgtctcactgttccatgcctttgcagatgccgtttcctctactcttacctgttgaatccctactcatccaaagccggttcaaatgtgctctcctttgggaagcccttcctgtccctccaaagtggatattttgctctcctccttataatcccatagcacttatccaggacctatgtccagtacttctcttgttagctagagattgtttaaagatgtacctatttatcccactggtctgagtactccctatccccatgcagtagtgagaacaagcttccatagtccaaggactagaatcatggcatctggctatggccagtctgtgtcctggactctgctcttcttatttctctgctgagtccaaaacaaacactgtcatggtcccccagggaacttgagaaacagagaaaatccaggtgacaggaattgatgttgaacaagctggtgctactggataaaatctcataacaatccctgatcagcttcctgtcattaagataaatggcccagtgctgatggctctgcaattaccagctcttctaattgaatgtcgagaccctgcttttggaaaaccagtggcttaagccctccctgcccaaccctaggtatatgttctctttggtctctattcaaattcaacagacaggtattgagtgcctaccatgtgccaggcattgtgcaaggcattttataaacgtatcttcatttaatcatcataacaatcctatcaggaggatattatcatctccatttgaaatatgataaaaaacctgatggctccagaggtgaaaggatttgcttgagattactcagctaataaagacgacaggtatcatttagtgagttcctactgtgtgtctggcactgtgtaaaatactctatggccactattttaactatacaactctgaaaagtagatattataatctccattgtatagctggggaaaacagggctcaaaaatgaaatgatttgaccaatatctcatgactagtaagtggcagagctgggactattaatccatgtctttctgtctttagattcagtagtctttctaccacaccacatggtctctttgacctccatcacactagagttctccaaattgaaaggctgtattatccatggcaaagagaatctgttcacagtggtgcttagcatgtggcacggacaaattaaagaatgaaagccaggatgctccaacccaaactttagggacaggtactgctgtgaaaacagtcctagggagggccagcccattttgtggcacactgccctgcctcttcaggtccctggggtgagcatctttaattctcagggtcctggaggaaagctactttcctggcatgaaacgagttttcaatgaggaaacatattcccatcacaagcccattgctcgagagacaatctttgttgacaaaaattgaacagaaataggagctgaagctgaagccacaaacttttccatatggtcatcttttgggagacacatggatgatatagctggcacatctgctaagcatccttcctgggagccactagtttcctgtgtggtcctggacttcatttccaccacaaatccaatgaggtgatacaccagaagccctctaaggttcgtctagtttaaacctacagttctgggtcctcaagaagccaactttgattagctggtaacctgttgagtgctgggagtttctcgggccagctcccaggttagtgtcaggagcgccatatacctaagtggccagttttggacatatcatcaagttgggtgcttcatcttcttcctgacaggctcttaaagtaagtggactgatggggtggacaggaaaatgatgactctggcgcagactcagcaagatcctttagtctccccaccaccagccagagccaaagccaaatgaaatggcctttggaacagaactggctcattccattaaggagatgagagttctattaattggaaagaaagtttcaaaggcaggcaggtcagcaaccaaggcccatggctaagcactactctctgggtaggataaatgggggcattctccaggctttgtggtagaggttggagagcaagaaggcagctgagctcaaatggagagcaccagcctggcaaatacaattagaaccagtcagggctgcccttacccactcctcatccctgccacttcaaactccttcacatcgacagaattccatgtcctgttttcaaaccccagcccattccccattactttctgaatttgtcctccctgcttatgttataattccctgatgctgtggaacatttcaagcatgatagaaggctctctcgtgccttttcccagttaatattcctccaagaggtaaccactaatccagaatcatctggaaggcttgttgcacggatgactgagccccaccttcagagattctcattaaatagatctggatgcagctcaagaatctgcatttataacaagttctgaagtgctgctgttgctttgagatgcactgtgctagtctgacttctatcagcaatgttcagcttgcttgttcttcaatgtactctttcatgtctgccttcttttattcatccctacgtctgtaaaattcatccatgttgttgaatgagccagtagtttattttttactgtatttgtagcatttcattgtatgaacatatggcattttatttatcattccactgctgagtggacatttgagtgatttctaattagggactattatgtatgatgttgttgctatgaacattctttctttgtcctttttagaaggtttatttttatttttattttattttaattttaagttcctggatacatgtgcagaaggtgcaggtttgttacataggtaaacgtataccatggtagttttctgtacctatcaacccatcacctaggtattaagtttcgcatgcattagctatttattctgatgctctccctccccgcaccccctgacagtctccagtgtatgccagtgtgtgttgttctcctccctgtgtccatgtgttctcattggctataaacactcttgtacatgtttttaggtgggcatatgcacttatttctcaatatacctaagtatagaattgcttgatcataggttaggttagatcaagtatgtattttactttgttagatactgtcaaacaattttctaaagtgattgttcctatttgtacgcctaccaggagagtatatgaattcttggtgctccttatccttcccaacacttgtactgatatcttttaaaagaatttagccatttttggatgtgtgtgtgtgtgtgtgtgtgttcatggttttaatttgcatttaggatttaactagatttcatagtgtaaaattgtttgtagtgatggaaatgtccagtacagggccttcaaacaagtgacagctggtatggacactgcacataccagctcagatggtatggaggagcactggatgaagaaaggatggggaaatgctcaagggaaaatccaagcttcttcacttttttggttcactattctcccttgtataaacaaggcaattctccccttggaatggagttgaggcctcaaagttggcttttgagcttgggaatactgagactgttaatgccaatcctccagatggaaatgaacttggtatattggaggtatagaagaagggtaatatggtttaaatgtaagaataaaaggggaggatatagataatatcagagagatcagcagggaccatcttttagagggtcttgtaggttttgggaaagagctaggagctcattccaagcacaatgagaatccagcaaagggtttttgaagggagagtgacagaacatgatttatattttgaaaatatcactgtgtttaatgtgtagggcaatggttctcatccttggctgcaccttggacttatctggagagctttaaaaaataccgattccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgacatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgttggattcggtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagagttgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagacagtttgttataatttctgttcttttacatttgctgaggagagctttacttccaactatgtggtcaattttggaataggtgtggtgtggtgctgaaaaaaatgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcatcctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggttgggggcggggggagggatagtattgggagatatacctaatgctagatgacgcattagtgggtgcagcgcaccagcatggcacatgtatacatatgtaactaacctgcacaatgtgcacatgtaccctaaaacttagagtataataaaaaaaataaaataaaataaaataaaaataaatgaaaaaaaaagaaaaaaaaaaataccgattcctgagtttcacctccttagattctgattcaattggcctggagaacagcccaggaatttcaagttaagacagagagaagtggacatatttgagacatattttggatgtgagacatactgggtttggggagtctctgtggactatagggagagaaaggggtaaaagaagtgacccagcatcttacttgggacttttaacagatggtggtgccattcactacaatggggagcactgagggaagaggagcagattgggggtggggccataagttcagtgttggctatgttgagtttaagatacgtgatctgttcagggaggtagacaggactccataatagactggatttggaaagggcaaagggagaggaagagccgtagaggatttcctgtgctcatgtcctatattctcatcttggtcatttccacttctctgattgggatcctatctctgttctctggatactaatagcctaatcaggtaaacttcttcctgcaaatgtgttaactctattttataaccccttgagatgcctttacccaactaaaatacacaagtcctacgtccttcaaagagtagctcttctgatagaaatttgaagcctctgtggatgattggtggggaaaggttgaaagaaactgtgctagaattttgccccttcaatttcagtgagaaggagatggacttatcaagataaaacagggtgtgccctgacttcctttaggaaaattcaaacgctgagctagaagttttatatctattatctcatttagtatctcaaatcacttgagttgttattattactattttacaattaaagaaaccaaggccaaggaaggttaagcaactcattcagagtcatacaactagtcagatttagaacccagaagcatatttctgccatgagtgctgagagatttttattcattaattcattctcattgtgcactagagtacatgcctctgggagtccagaggatcctgcatagagcccttctgaggagtatcaagggagtaaagagttcctttagatagaaactaggttgactggtggactggagtaggatcaccattagtgagctccatctcctgggtcctgccttgtagtaatctgtcaccacttctgctcctgaaacagagattcccaagagcagcaagagcctttaaagagcaaagaggctcgttctaaaggtagggaaacaggttagagagagacaaggtagtttgcccaaagtcacagagccaattagaggcagaatcagggaaaaccttttggtgggaggttcccaagagcatatatctccaggaggatgcagctttctaaaagaagtaagtaggggaaagagcagaaagaatcctggggctatagcagagaactctgcccagaaccactgcagtcacgtcctactcactgcttgctccctgtgccagccaaccccacagccttcgctcagggctggaaaaagacacgggacagggctccttaatgagaacatttgggaacccgggaaaggttaatgatctgcagcctcgaccatccatcagctgcctagccagggacagtaaacaccgttactcatctaattagccaggaaaggctgggcaggggctgaagatggggccttggagattacaaagtaagggtccacttgcttagggtgctgagagaggctaccagagggcacaggccaccattcctggaggcatttgtaagggggctcactcttagctggtccccctgcagctctggctgcaggcatgtggtgaaaggcatggatatttattgagggcctcttctgtgtcaggcactgtactcatcaattctacgtgtcaatttattgtgtcccccccaacaacactgcaaagttcttacatttattgagcacctgctgtatgccagtcactatatatatatgtatatgtatatatacacacacacatatacactatatatacacacacacatatatacactatatatatatatatatagtgtatatattgcaaatagttgctgcaacataaaaaatagttttttttttcacgagaaataggtccaatcttctgggctactaaagggagtgaatgtgcatataagtgtgtgcctgggtgcttgcatttgtgtgtgtggagttgacagaaaccaccacataggcatgtgtatacttcttcctcacactctcacccatacaagcatagcttcttgcaaagttgaatgcaacccaacacactatacatatatatatatatatatatatatatatatggtgagtgattggcatatatatatatatatatatatatatatatatatatatatagagagagagagagagagagagagagtcatatcttaatccttccaagaatcctaggaagtagttggtattgtcctcatgatatggttttgttctgtgtccccacccaaatctcatcataaattgtaatctccaagtgtcaggggaggggtctgggggaaggtgattgaatcgtaggggcagacttccctcttgctgttctcatgacagtgaatgatttctcacaagatcctgttgtttaaaagagtgtggcacttccgccttccctctctctctctcctgctccaccatgggaagatgtgccttgctcccccttcatcttccaccatgattgtaagtttcctgaggcttcccagtcatgcttcctgttaagcctgcagaactgcgagtcaactaaacctcttctattcataaattacccagtctcaggtagttctttatagcagtgtgaaaacggacaaatacactccattttacaggagagaaaaccgagcatgattggttaatttgctgatctattcagcaaatatgtattcatgcccactctgtgccaggcactgtgctaggtcctagggatataatggtaaaaagacacacattttgcccttgtggggtacctactgtctaatggtggagacaaacattaaacatgagctccacaactagaaaacagcaaaactagatagggatctagtgtaggggaaagctgtaagaaggatgatgaggggcctgaggtgacaggtgctgtggcaatcagaccagtatacccttgctcataactggcctagtctgacttcaggaggctaggccctggggtaaatgatgtatttctgcttggggaagtgggagataccactctagacatatgtgctcattggactctgtgccagtgagtgggagagaattctctagatacatgtgcacatcagacacatgtgctcaaaggttctttgctttcccagctgccatgaatgattccagctccagagaggaggtattggggttagggataactttgtgattgctgaacagtcaatggagtgggccacagctggggaatgggtattctttgagcacctggtgtgtgccaaaccctgtgcgaagtcctgtgaggaggtggctggaagcagtcaaagactgtttttttccagggaggcttttaatataggttgcaaatgggacttatttttgtggaaagattaaggaagatagccagttaagagctgaatagggcagttctgactcatcagcttagaagcctgggactccttgaggacttcttggaagagagagagggagggaagcagagcaacacacagagtgtgaaggtgggtaagcagaaaagtgtgatggagagggagagagaaaataggagacagcaagagatagaggaaagagacagagacaaagtgtgatagagaccagagcaacagagagactgacagacaaaatgagacggtagagggagtgagagagaaagagaaagtctggggcctgcagttggacaggaggaagctcaaatgatgaggtcaccccgcacccaatttgaggccctacagaccattgtggaatcaggcttcaaatggttgctgcatcataaacaaaatagttgtgtgtgtgtgtttttttttcaccagagatggctccaatcttctgggcaactaaagggagtgaatgtgcatataagtgtgtgcctgggcgcttgcaattgtatgtgcggagttgacagaaaccaccacataggcatgtgtatacttcttcacactctcacccttataagcatagcttcttgcaaagttgaatgcaacccaagttgtgaagggaatcccctttttccactaaatgacattttcactccgtttaggaaaggtctccactggaaagtgagttcttgtcatttgaaccataagaaaatgccatccccaaaccagggatatcaaaagacctggactcacatccatacaaaatcagaatttagtcacttatcagatctgtgatcttgagccgtgtggtcaacttctcggggtctcaattttctccccaacaatgaggtagttgtattcagtccttggacactttcccacttgagcaagtgcaagaaacaggtgtagactgggtccccaaggaaatctatcctaatgaccgtaatttgaaagggtagatggggggaggggatctgttgatcagaaggcagcgtggaatgaagcaggggtataaataaagtaatgcctaaataagtcgactgaaatggaatgggcccctggaaactcagcccttggtctggctctcttggcccagttggctggctcaagggaggagccttccacctctcaaaaccctcttggctcccatctgcctcctgcccgtcttccactttctgcttagtagggttaatgtagtctgctttgcagtagaggaaatgccttcacaccctatttttatttacagtggcaaatttctgttgtgtgcaatggaataggccagtgtcaggaaggattaatggggactcccaactgagaacgcagcatgaataatggtgggaggagagacagagtgaaaagcctgatatggggttcttcaggccagttaagggtgctttggggaaaaatggtcatatcttactttattagttatgggcaaagttaatctcctcctctgcacccccaacgcctctgtcccagaccagcttgtcttactttctgactggattattgcaacagccttttcccaggcctctttgcctctagcttcttggctctattccattcaccactcttcacctttatctttctatatcccgacattgatcacttatcccatctacttgactatgacctatacgagagaagagattgagtcatcttgttaattgcctaatttcctttgccaagcaccgtgtttttcatagaggagatgcttaataaatgtttgacaggtgattcaatgaataaataaataccatggaccagtgactatgctcatcattgtaggatagtcctctcatgtgctcccacagtcgacaatgtttgccccatcaaagaacttatgctatagtttgtaactgcttgtttatgagactgagaattctgtgaggacagggaccacatttgtcgggtttaccttcccagacatatgttacgttcacaccctgcacggtgttgaacgaatgcatgaatcagtgttccacgggaaatatattttacctccatttctaactgtacattcagcagttactgattgggcacctactatgtgcaaggccgtgtctaggcattggaaatttttcagtgaacaagacagacaaaagcctctgctttgatggagtttatattttagtgaggaagacagtcaataaatcaatggacacatatttatataagaaaatgtcaagtagtgataagagctatgaagaaaaatgatgcagggcaaaggggtagacaatggtggagaagattcctattttagcttgggactctgaggagagaacatataaaagacctgaatgaggtgagtgatgaggcattccaagcagagaggactaagagtgccaatgccctgatacaggaatgtgtttggcaagtttcaggaatagtaaggaggccagtgtggctaaagtacagtgaacaaggagatgggcatacgagatcagagagctaggcagggtccagatcatgtagggctgtggaggccataataaagttgagagactgctctaagtaaaattaaaagccaacaaaagactttaatgcaggcagtcagcaacaatttatttatttgttattaaatagtaggtctgtgaaccctggtgaggaaaatcctggaggcaagaggagacaacccagttagaaagctagtgcaatagaccaggtgatgcatgatgatagcttggtccactattagtaatgggagtgaggaggaagtggttggatcaggatatattttgagtacagagccaacatatctggatagtttggatgtatggtaggagatagttcaaagccacctcctctgggaagccttccctgacattccttaccttcctaccatggaaatcaatgtctctccctagatactcatgtcacttttcagctctataatgttaatgacagcattccatcttccggcagagctgagatacctgttcacatctactactcccactcgacttagacctcctcagggaccctggtggtcatctttgtagtctttaccagaccctgtacgatgacttatgcagaatagttgaccaataaatactggtgagattgaatagattaactaaattgaagctgtttattattgcttccagtgtatggttgcaaaactctccaatcatagaatgtaagcagaagaattatttcaacatcaccagcttttaattactaaagtccatttgatggatgcctctgcttgaattattgacatcatgaggattaagatgtggtcccttgattaaaaagaagggttgagtgaggggcgtggagagcgccagagggtgggatatttaatgaagccttttctctcagctcatgttcagctagtgaagctgtcaggggaagtgaaaactatctagaggaggatcgagctgatatttataaaaacggcagaagtgagaggaggcagggacatttgaagcataaaagttggagcacatgtacctggattcaaattttagctttctcatttgctacttacggctctctgagaaagtgtttaaaaagttgtttcatttgcttttaactgagatacaacttacatacaaaaatacataaatcttaagtgtacaacctaatgaatttttagagatgtatacatcatgtacccatctcctataaaaatgtagaacatttccagcacctcagcaggctccgatatgctccttctagttagtatcccctgcagaggtagctactatgataacttctattaccgtgtagccattttgtctgtttttaatcttcatgtaaacaaaataatgcagaatgttctctagtgtctggcttctttctgagaaagtcatttaaaccctttaggcctcagtttcctcagtctttataacaggaatactagtagtagcagttatatcaaagaggtatgaagatttcatgagataaatcatataaaatgcttagaatagtgtgtacgggataaatattagtcctttccttccatcctttccttgtaagttcctacagctatgataagcactattgggctacaagggaagtataaagggcagttgatacccttaaggaacttataatctagttagacacaaggatgtaatgtacttggtaagcataaaggacaatattaatatattcttaatataatgaatataatgatgtcaattactaatcccactgctgagtgaagaggaggcaggtgatatagtgaaatggttaaaagatttcaggttttgaaatctttggacttgggttctagcaccagtttccccaattaccagctgtgtgactctggggatgtcacataatgttgctaagccttagtttctttatatttaaaatgggaataacactattttatctacctcatgggattgctgacaacattgagtgcaacatgttaagtgcctggtacaggtcctgaaatatagtatacatttaaacagtggtatttgctgagagctttttctgctttgggataccaggattcaaaaagatccagagctttcaccctaccagggttagctaagtggcttgcaaggcctcatctactgcagttgaataaggtgactgctgaagctcaaagggccacttcttcatttacccctctacagttctccagtagacacttgtggcagtaccagggaccatggagttaaggactctgcctctgccttggggagcccccagacttgctcctttcttgttcataaggctaaatatataatgatccaggcctatagccgggaccctttgcagccctcaggcaggagccatggctagttggtcccagtgcagcaatggggggactcactgtgatggaggagtaaataaacttttaaaaataaagacaatcttttagggcagcttgaagttcacagataaatggacaggaaggttcagagatcttccatataccctctgctcccacacatgcacagcctcccctgttatcaacatttcctcaccagagtgatacatttctttcaattgatgaatcgctacattgacacaccattatccaaagtccacagtttacgctagggttcactcatggtgttgtacattctatggctttgggcatatgtatgatgacatgtagtcaacattatagtgccatacagagtagtttcactgcccccaaaatcttctgcactctacttattcatcccaccttccgcctagtccctgacaaccatagattcttttactatttccatagttttgcctgaggaatgcaattttcatagccattttgaaaccaacatttgaaaatcaaaattctttaaacactgttaagcatcacagtgttttgagaaaatattttcagaatggttttatgcagtctgcttcccactgctcaaaacaaaagtttttttagaaaaaaacttaaaaatcaacatgtcttaaaaatatttttcaaaccaaaacaaatgtctcaaaagctatttgcagatatgatgattggtaagatgattcagccctgaggaatattttctctagtgttattctgatgcttacattttgaggatttgatttagtcagattattttctcaaaactatatttattttctatctatcctgaaactcagctaacagaccaaagaaattcaaaccttaaagctgcaacatgaaacatttattgaataaatgaatcattttttcctttttgtcttggctaccaggaaactcagagttatgttaggtagaggaaactgtttcacctttggttctccctttctctacatgattttcctatcattcttttgatctttatttatctgccctatttctctgaatttttatgttaatctgtttcaaatcgattttggatgtagatggaactacatctacggatgaatctatggaaagatgcccagtttcagtagtactcatataaatgcaaatttaaaaatccacaaaatattgcttaacacacatttgaatggcaaagttataaagccagataatattatgagctgatgatgatatgagaaatcatatattaagttctgttggttggagtgtgaagtggtagagccactcaggagagcaatctgaaggtgcttaatgaaactaaatatgcataaactctatgaatgagtttataattctataacagaaccattaagggacatgtgcaagggtgtttataaaatcattgtttgtgatagcactgaaagcaatatagatttctattactaaaagactgaataagtaaaatgtgacatatgcacatgctaagaatactatgtgaagtcagaactctagtcaagatacacatattagctctagcttccgtaataaaatgccatagactgggtggcttaaacagcagaaattaattttctcacagttctgggggctagaagtccaagattagggtgctagcatggttgagttctgatgagggctctcttcccggcttgcagatgattgctttctcactgtgtccccacatggcgcagagagagagagagagagagagagagagctagttctctgatattgcttcttataagggtacaaatcccatcatgagggctctgtaatcattacctcatctaacacttccaaggccccgttctaactaccaacacattgggagttatggcttcaacatatgagttccggggggacacaaactttcattccataacattttgcccctagccccccaaaattcatgtctttctcacatgcaaaatatatgcagtccatctcaacagacccaaaagtcttaactcagtccagcaacaactctaaagtcttaagtgcaaggtatcatctaaatatcgtctaaatcatgtatgagtgagactcaaggtacaatttgtcctgaggctaaatttctctctagctgtgaacctgtggaaacagacaagttatgactgaacttgttttgtggttttttttttttttcactgggattctggaaaggagatccttagaggaacaggggagaaattggggatattttgcctagggttgagagatgtcttggctgtctttagaagtcagaggatttgtcatttgcagagacagaactgtgccttaaagctccagagaaaatccataggccatagaaataagtcttcaaagagataacattacttaatggtaaaacaaatcaaaagcacagtaatattaatagttgctgcttacatttactgatcacttactaggtgccacgctctgggttgagcattttaaattcattatcttaatttgttctctcagagatgcaatgaactaagtgttcaaaccacctcttcaaaaaaactggcataagaaaaaaacaaaattgactatattgaaactttgtccctagaatttaatcaaattaaaatgaatcttttcagtagtagaattgttttttccactagatttcaaggcatgaaactccattaagacatagagcatcatactataccagcatctaccacccttgtgatgatcatttcctgaactctaaggaccagctcacaggcttccttgacactccaagttctgtcctcatcctgggtgtcctcaacaatatacacacgaaagtcccaccccaaacaccctggcctcacgtctctctgacctttaacttctgagcacctcaaccactcccattcacttgacatcactgggtgtggcttcaactccaatatcccactgaggcccaaatcccctgatgaaggctgggtccatgccatttgctctttggcttcactgaggggccagagcccaagaccttccttttctcttcacttttttccttgtccagccaggatcttggagcatatttatttagtattgactgcctcttcttccccttgccctccaatgaccacatctgcactatttagcctcagttttgagtctctccaaactaatgatttctctgatgtcataatggccactgtgggagaaaggagcagcaccccaagtattggtacctctaacagtcagaatttccaacctcagttggtccttctggccaccctgcaatcctttcacatgccccaagtcacctctttctccagtttttctcccatctatactccaagtttttcatcactcctctcaaagaacagtccctttcactctaccctcaccgcaccccatacaatggctaagactcctaattcataaaggagattgaagttaacttcagcttcttgtccccatacctacaaaggtctctttggcttcactagctctcacttcacatttctcttttagtttcagaagaactggccctcatcctctagtttctccacctttgctctgtacaccctcctctaattttcctcctcctatctcccctagaatcttgcttatactactatccattctctttcctgactctttattccctctctccctaccagttccctaacctcaggttattcatatgctcaactgtccctcttctttagaaatcttttcttgccaccactgtccccttcatctactattaaagctgctctcatcttttaagtctaaaaaatcagtggtctatacccaatctcagttttctcacttcctattcttttttcaactcagtgtgatcaatcatactactccactgtgctacatttaccatgattactctttagtcctgctcttactttttattacagttgtattgaagcatataataaattgcacatatttaaaatatacattttgatgagttttgacacacgtatacacccatgaaactatcacctcaatcaagataatgaacatatctgtcaccaacaaaagtttcgagataccctttggtaaaccaaacagcccacacactgtccctaagcagccattgatctgcttttatcaacacagattagtttgcatttcctagaattttatataaatggattcagacaggatgtactctttttttgtctggcttatttcactcaaaataattattttgagactcatccatgttgtgcatgcatcaacagtttgctcttttaaattgctaagtagcatcccattgtataaatatgccacaatttatttatccattctcctgttgatgaacatttgggttgtttacagtttgtggctgtttttaataaagctgcaatgagcatttgtgggctagtgtatatgctttcatttctcttcggtaaatagctaggagaaggatgaatgggttgtaatataggtatatgtttaactttttaagaaactgccacattgttttccaaagtggatataccattttatattcccatgagaaatgaatgaaaattccagttgttccacatcctcaccaacattggtatggtcagtcttttcattttagacattctaatggatgtgtaatgatatctcattgtggttttgattcacatttctttaaggacaaatgatgttgaacatcttttcatgtacatatttgccatttgtatttcttctttcgtgaagtgtctattctaatctattgcctatttttagtgtattgcttatcttcttattattgagttataaaaattctttatatattctagatacaagtcctttattggatatgtgatttgtaaatgttttctcccatctgtgacttgcctttttattttactaatagtattttttaggaaacaatagtttttaattttgatgaagtccaattattgattttgcttaagtcctcatgcttattgtattctatttagaaaatctttgccaaatgtaaagtcacttagagtttctattaagtgttgtgctggaagttttatagttttagctcttacttttaagtctttgatccattttgagttaatttttatatataacatgagataagggctgaggccctacttttttatacgtgatctttccattgtttcagaagtttgttgaaaaagatttccccattaaattgccttgccatctttgtgaaaaatcaaatgaccttatatgtgtgggtctattttggactctctattctgttctattgatatataagtctgtttttataccaatactatactatcttgattattatacctttactataaatcttaaaaccaggcagttattcgttttttattaaagttatttttgacacatctaggtcctttgaattcctatgtaaattttagaatcaacttgtcaatatctatacagaagcctactgggattttgaatgggattatgatgaatctgtagatcaatttggagaaaactgctatcttatcattattgagctttctgatccataaacataactttccatttgtttaggtcttttaaaatttctttcagcaatattatgtacatgttttccatgttatttgtcgaatttattcctaagtattttatattatttgacggtattgaaaataatatttaaaatttttcaatttccttttgtttgttgctagggtacaaaaattgatttttgtatattgaccttgtatcctgcaaccttgctaaactcacttattacttttaatagcttttttgtagattccttacgattttctacagagatgatcctgtagtctgggaataaaatatctttgttccaaatacatatgtcttttatgtgttttctcaccttattgtattgagtgtggtctccagtaaaatattgaacagaagtggtgaaagtagacacccttaccttactactgaatcttagggcaaaagcattcagtctttcaacattcagtgtgatattagcagcaggttttccatttatcagtttgaagatgctgtcttctatggcaggtttgcatagaagtttctatttttaacaccaggaatggacattgaatattgtagaacgtgtttttgctacattactaagataattatatggattttctttgttaatatggtgaattattatatattgacattttcaaatattaatccaactttgcaatccttgaataaatttcacttaactatgatgtagtatcttttaaatgtattactgggtttgatttcataaaattagttaaacattttcatcttcatgcttgtaagagatattgatatatagtttgctttacttgtattgattacaactggttttagtctcagggtaatgctggctcatagactgagtcgtaaagtattccctcatctttacatttctggaaatgtttgtgtaggattggtattatttctttcttcaatatttggtaaaaatgaccagaaaagccgtctggtcctagaattttttatgtagaaaggttttcaactacaaattctttcttcttgagcgagctttgatagcttacatcttttaagaaatttgctcatttcatctaagttgttgaaactattagcctaaaattgtctataatattctttcattatctgtaaaatctgcagtggtatcacctctctcattcctgatattagtaaattatgtcttctttcttttttttcctgaacagtctggctagaggtttaacaattttatttatctactcaaaaaattagcttttggttttgttgattttcacaattgtatttctgttttacataatattttattgatttctacccttaactttatgcccctctttctccttactttgagcttaatttgcttttactttatagtttcttaaagtggaagtttagattattgatatgagccctttcttcttttctaatatagcctttcatagtataaattgtcctctgagcactacttcatctgcaatctgcaaaattggtattttgcattatcatttttattcacttcaaaatattttccatttcttatgagttcctatttgacccacgggtaatttaagtgtattgtttaggtttttttttaaaatatttgggaacttttcagatgtctttctgttactggtttctaattcaattccatattgatcagaatatatttgtataattttactatttttttaaagtattcaggtttgttttatgagccataatatggtctatcatgataaatgttctatctgtactcggaaaaatatttattccaatactttgggtgaagtgctctataaatgtcacttcggtcaatttcgttgaaagcgcttttttagtcttttccaatctcactaaccttctacttttctatcatttgttgctactatagtttggatatacctccaagcctcctgttgaaatttaatccccgatgttggaagtggagcctaatgggatgtgtttgggtcatgggggctgatacctcatgaatagattcatgtcctccctgagatgagggaaagtgagttcttgccctcttagttcccacaaaagctggtttttaaaaagagcctggaacctccccacaccttggtttctctcttgctatgtgatctttgtacttgctggctcccgttcgccttctgccatgagtggaagctccctgaagccctcatcaggagcaaatgcttgctccatgcttcttgtatagcctgcacaactatgagccaaataaaactaattcctttaaaaattccccagccttagatattcctttatagcaacacaaaatagactaagacagaagggtagtgaaatctccaaccatgatcgtggatttgtctaagctctatcagtgtttgcatcatgtatttttgaacctcattatataagattattatgtatttttaatgaattaacctgtttaacattatgaaaagacccccactggtctgaagtctactttgcatgtattgatatagccactttagctttcctgtgtccattgttagcatggttaacaggtttgtttcagtgcttttaaatatattttttttctgatgtcttataacttgcatcatttccaataagaaatctgctgtctttcttataattgtccctctttaggtaatgtgtcttccaccacccacctaacccaccccactcccagtccccttgtactggcttcttttaagatttatcttaaagataagattttatctttatcactgattttaagcaattgggttatgatgtcccttggtgtagtttttcacaatttttatgcttgggatttgttgagattcttagatttgtgggttcataatttttatctaatttgaaaaatattcagccattatttcttaaaatattttttctgtcctccctcctcctttgatgactctgattatgtctatgaggctgatttcagtggtctcacagctcattaacactatgttgacattttttatttttcctctctttgtttaattttcaggcttctaacgttatgtcttcaaatccagtaatcttttctctgcaagttcctttttcaccatttaccccataaacactgatgttttatcagggatcatttttatgccaccttttcttctcgctctgcacactcatacacttctagggcttcagttaccatttttattttgatcactgccaaaactgtatctttagaccagaccattcagtattctagtatttctgactgcctatttgacatcttcccctgcttaaccctgcactttagcttatatagaaactattatctcctcctgtatgttttatcacagtaaatagcaacacaaaacaactggttacccaaacatgaaacatgggtctcattcaagatcctttttgaaggcttatatattgttttaggcatttatgtatacctaggtttctagcacaatgcttagcatattaaaatgcttagtaaatgtttattgatgtataaagttatttttccatgggtttaaaatttgtaagattcatggtaggatttgaatctagatttttatgaatttaaatccttgtttcatccaccacgtgatattatcttcaaggtaaatagtccaattccttaaatctttatttcttgaaatttctccattcttgtacagtctttccatgtgtattttaaagtatgagacttttaagtctggaaatctatagaaagtgtggaagtttgtattttccaaagacagctacaacaatatgtcatattctatatgctgttttgcaatgccactaccccatcaagaagtagagtctatttctctaactttttgagactggatgggacctgtgactgcttttaccaataaaatacaatagaagtgatgctgttacagtacttggaatagctcttaactgctctggaaattttcactgatttcttgaaagccagccaacatgtgactaccctaagaccatcaacgctatgaaaagctcaagtcatattgagtgggcctggaggatgagatgtcatattgaggtggggtacaaggttccagaccttgaggacatgtaggtgcagaagcgatcttgaaagtggagtgtccagtcccagccctccagccaactccacatgaatgagaaacaaaccactaggcaaggccgtctcaaattcctgatccatgaaataatgaataacataaaattgttgcttaagaccactaaattttggatggtttgtagcacaacaacagataagcaaaatggaagagaaggaaatatgactaacatgcctataatcatggaaggtttagatcaaaatctttttctcctaagccccaaaataccaagaaaaggaagtcaacctagagggtaggaagattgaataaagacatataagagacttccttaataccctcatcaggaaataaatacatagagattgatacacccttgaaatggtaaagaaaaactatgtatgatttccaaacaggaaacaaaaaatagaattgcttttcaatagtacagatggcaaagagcaagaagaagatctagctattttggagggcagaaagagtattccccaaagtcatgactagcttgaataatgggttaaatataaaagaatttagcagtcattaatgaaaagtgaggcaattgagttcaacctgcatatgtatacaaataattaaaatgaccagtgagaaaataatttaggtgccagtaactgctcagagataataacttcttaaaccacattattagaagtggaaaattccaaatgaagaaggctgatcagctttttttactcagaaaaaaacctggaagattgtcctcagttatgtgagcaattgggagaattcgaggacacaaagccataccacgtggaggaactgttgactttttaggtctgtgtcaaccacgaaagtctttgaaactatatatttagatgcattcttgaaattctgaacgtctcacgcaattccttaatacctagtcccagcctggatccactgtaatggtgttcttcaaatctaacttcataatactctaacagggtctggaaaggcagagcccagagggagaattgcttctgggctttctcattgcaagatttgattaaggcaggctttcccgtaagacttctgaggtagactggggtgggtcttgtttggatgtccctgttatttcacaaacaggaaggatttccaatttcccacttagaaagaagaaccagcaggcctggggtcaaggtcagttggacatgacttcaccagagttttgccccgtgtgcttgctttgtgatgtatgactcatcataattaaattttgagctagattaactataattcctgcacttattaggcgatcagtgtttaaagcccttgtaaaagaggatgagctgctcattctgataatgcaattaactacccaacagagctaatattttattttagggaagagtaatttttgattaatgatgcattttatttcccaaatccctgcagcagtgggtcacatctttggtgagaaagccaaagaaaaagggtaaaattagaaaacttggagtgtttggaggcagattagtgtggattctacagagctggctgctctcttggagcccactcccaattcctgaactcctgctctcttaggtttacatgtacctcaggattctccacagcagaatacacctcaagaatatttttggggagcataaatctcccttgttccaatttcttcttacagaaacaggacataacatcagcatttctgaagttctttggctatgagatgctatttaattccattattcccagagcaagatctatgtgaagagaggactggttgagagggatccagagatgcttcctggaagaagtgatatttgaaaagagtactgattcatggcttgtgtgagaattggggcgcattatttggggtcaaggacatcagttagaaggctattttaggaatccagttgagatatcagcagggagataaagagaagcagacatagtcggctaatattaaagaagtagaaatttcaagacttgcttgttgattagatatttaggggacagtgggtggagagtgtcaagaaaaaggtctaggtgcctaatttgcatgatgaagcatatgatagtagattaggtggaaaagcatgtttgtttcttctagaatggtggaagagatttcttctagaagtttatttcttctagaatggtgaaagagatttcgagttggagttaactgtggtacatcaaagtggagatgtacaatgaggcaactggatttgtgggacatggactcagaaaagagaagataaagatttagaggttattggcaaagaagttgcaaccatgagtgtggaccacattgctcaggaatggcatcttcaaattagactatgagaagaggaccaggaactaaactaaaaaagactaactccaaagaagtaagccaaggaggagccaggaagaagactgagcagaaataggtatcagtggctttaactatggggaagtgaggaccactgaagcaaagggcaggaaaaataccttgaacaaaatgaatctgcatcctcaacaagtggaattcatgggagataggctgaggatgacactacaggtttaaagtttagcacaagtaaaggcatagaaggtgaactggggaaggtgccaaggccaaaatttcagtgaacaaaattgagcattttccagcatggagatttctcaaagaactaaaaatagaactaccatttgattcagcaatcctactactgggtttctcctgaaatgaaaataaatcattatttttttaaaatgcctgcactcacatgtttatcacagcactagttacaatagcaaagtcacagaatcaacctacatgtccatcaacggatgactggataaagaaaatgtggtgtatgtatacaccatcgaatactacccagccataaaaagaatgaagtcatgtttttttgcaggaagatggatggaactgggggctattatcttaagtgaaatagctcagtatcagaaagacaaataccacatgttctcacttagaagtgggagccaaacaatggatacacatgaacatacagggagaaataacagacattggagacttcaaaaggtgggagagtgggagacggatgaggattgaaaaattacgtattggctacagtgtttactctttggggggatgggtacactaaaagcccagacttcaccactaggcaatatatgcatgtaagaaatctggacttctaccccctaaatatataaaaacaattttaaaaaaccaaaattgagcacattttctctgaaagcaacttgccattatttgctaccctgccaaaaagacttagtgtggctttccctcttttggaaccaatgtaagcatcactattttttcccttggcctgtggatccgagggagcagcgtccatcctttgtgccttcctcaaatccttcctgcacagccactgctggcctctgagaaggatggaaactgatgctgggcccacagtattccaaacttaccatgatctggcccaaatatatattcccatcttatctttttctttcttgtatccaatcccagctccatcaaaatagaattattcactgattcccttctaatccgtctggtttcttaccactgtgcctatatcatgctgttctcttcctggcagtccctacacccacccagctcctatttcttcaaattctactcatccttccttggtcagtttcatatagcatgaagtcatcccacatcccccaaacagcaaacagatctgaatcttttctctaggctaccagagcattttactctttcatggcatgaatcctactttgctatgtatttggaattagccatgtctgttttaaattcctccctcttagaccatgatgaattccttgaggctctggaccatatcctgcctttctttatatcttatccatcagcactaagcacagtgcctggcgcatatgaaatatttaataaatgcttatatactgaataaatgaatgaagaaatgaatgaagaaatgattcgtggaagagcccagtgataatctcagacagagaactttctcttatctggcttccagattccaaatggagtcttattacaagtcgtggatcttgtcttattccagtaagaaaaaggttttgcaaccatgtcatgttgaatctctcaatggtcatgtgcatagttactcattttctgtgttttcctttctccatatccaactgtaagctaatgctatgttataggagaaagagcctggcttgggtatgggataaagttggatttgaattctgatactatcttttactcactctctgtgattctagaacaggtcacttgccctctctgtgttctgtaaacaggagtgtccatctctgacttgcctcccttccaatactgctgtgaggccccagaaagatacggaatatacagcttctttgcaaaccatagactctgggcataggtgaggaattatcatagtgaggtaattaatatggcttgaaagaaggaaatgtagatcctgtcctggttggaccaggctgcatttttagtcactatgctggctcttgcagagctctgggacatggctttgggttatgtagatgacacttgttaatgacaacagtctatagggggaaaaactcagttacgctggggaatccaaggtagctagattggctagtggcaagcagagaacagactctgcctggaattggtaatgagatcgccgaaatggaagagaaaattgagccaaagtgtaaatgttcaagcagtttagggaaggggtgtgtgtgtgtgtgtgcatgcatgcatgcacacatatgtccgatggggagcaggggtctttaagagcaatgagtcttgtcatttgcataatagctcttgacaatttgcaaagcattatcatagccaccatctctgaggtcagagaacagtatctccttttccaagataacttcaactagaccaccatcttagtcttgacctttccttcccttcctttctcttctcttcccttttccttccctttgttttctttctcttccctttccttccatttcttttctttccctttctctcagtcaatatctccatccaatctcagttccctgaggatggttgtagaaactgagtctcagagagtgagaggagcagagatggaacatgaattttaggctgatgccctatttttctttagtatttaccttttttattgtgtataaaaccagtaaagcccattgtaaaatgtttgagaggagaggaaaacccagacacgtatgaagaagaaaacgtcagtcatccataatgatcaatattgggtccatatttccttccagctttttttctatgcaatttgacatgcttgagattctgctaaatgtaaatttataaattccagtatactttccactgcatcatgatctgttggtttccttttctacactaggcattgcctcttccaaacttctgtagcctttaaagccccacttgtcaaatagggtgtgtagtaatgcccccttggcttcttgcagctgaagtgagaatcctttgagattctaagggcaagggtattttggaaatctcagcatgtgatttgtggagggggtctcaagtgcagggtttggggttgaacagcaatagcctactctggctccttctcaagtaagcgcccctgtccactcactggagatgaatgtttccaggagcctccctgctaagcactcctttgagcagtctggctatgtcttcaccctctcatcctttccccctttgtcctttctctcctgtctccacttcgacctcaagtgacccttaagcaataacctgcaatggtgagtgggatttgatgatattaaatataacttgagagcacaagcaggacatcttgtacttttccaaactcatagtttaaaaaacacataataacatttattctctcatatttgtttttgtcgctattgggttaattcttgttctgcagatgtttgtgttacaaactgactattcttaggctgggcgtggtggctcacacctgtagtcccagcactttgggaggccgaggcgggtggatcacctgaggttgggagttcgagaccagcctgaccaacatggagaaaccctgtctctactaaaaatacaaaattagccaggcgtggtggtgcatgcctgcaatcccagctactcaggaggctgaggcaggagaattgcttgaacccaggaggcaaaggttctggtgagctgagatcacaccatagcactccagtctgggcaacaagagagaaactgtgtctcagagaaaaaaaaaaagaaagaaagaaaaagaaagaaagaaagaaaagaaaagaaagaaagaaagaaagaaaagaaaagaaagaaagaaagaaaagaaactgactattcttaatgtatctgtagatgagagaaactgaaaaaaagagatcccaatagtaagagttagaatatgcatggaatattaacttactgattaatggattttaatctattattatcttatactttcagtagtggcaagttcttcattgagggaggtggagaggtgtgatggttactggtggcttagtctcctgggaacttagctcactggggatgccagatcaatgcatccttgatgtgggtttctgacattggagtgaataaggttctgatgattaggtgacctgaggagggaagggaaaagagtgtttctctctcccagctactcatgtctttgatcaataaaactgtggttatgtagctactcatattcattttatacatcaaatattaatcccatagcacacagcagtatttctcaatgtgtgatctataaattatccatatcagaagcactttagtcgaggcctgggggtctgcatttgaaaagtatcccagatgatgcagatgcacaccaaaatctgatccccaatgctccagtctctcaagtactctgtgagaaaaaaaagatgccatggttagggaagtttcgaacacattgcctactatatccacctctgaagaggttcataatgcacattagcatattaaaagctctgaaaaatctttcagtaacagaacaatcttatgtccactaacataagattaattaaattatgatacacatacaataaactcctatactgtatttttttaaaatgaggtagccctcaaagaactaacaggcagcttggtgtagatgttaagagcatagattctggcaccagatagacctgaactcaaatccaacctctgccattaaataactgtaatcttaggaaagtcctctgagctgttttcttttctctacagtgggaataataacaatagtcttcatctcatggaagttattatgagttttaactgaatgaaaatatgaagtatttatagaattgtatttggtacgtggaaagtgtacagtaattattagctcttatgatcactgacatgggaaaatgcccatgatatattgttaaatcaaaagcaaggccaagaacaatacatatagcttgctttcatttgtgttaataaattgtacatcataaataatttcaaagataagtgtggaaggatactcagtattctgttaacagtgattacctttggggttaggtactgggagggaggaacgctgtcaattttcactttacatactttggtaagttttttttgtatttttctccccagctttattaagaggtaattgacaaacaaaattgtatatatttacaatgtacaatgtgacattttgatatatgcctacattgtgaaatgattgaatcaagctatttaacatatccattacctcacatagttagtatgtgtgtgtggtgagaatatttaagatatactcttagcaattttcaagtatacattattaataactgtagtcactatgctgtagaatagatctccagaatttcttcttcctaactgaaactttatatcctttgaccaacatctctccatttcccctccaccttttgtttttatttattttttaaagataacacacatcagggagataaaaggaattttgcccagaatggaacccagtatggcctggataatggaaaataatcaagtgttagcacggttctctcttgtttccagagaggcacattcagctacatttagcttttattgtttaaatttttttatttttgccagcctcaccattcttctgactcatccagctgtctgcctactgatctcctctgccttctgtatgctgacggctgctctgtatataagcctgtctttgtacatgtgaattttgaattcctaatgctggacattgcatttcacagaggtcagcccatgctccagcctactgagattgttttggatcctgagtctcccatccaatctgttagctagatcctctagcttcccagcatcctcactctcagagagcatgccatctgtctgagctgttggataagaatggtgacttgactgacactgatgtaaagatctgtgacctatcactagagacactgatccacatatcagcagccacctgctacctctggtgtctcacctgcagtctgtatttcttcactttatctataaaaggctcatgagagtctaagtcaaaagccttgttaaaatccagatgcatcctgtctacagcattctcctgatctacaagccttgtaaccttatcagaagagtaaattaagttagttctgccatgacttgttttcctaaaggccctacttagtgttattactaaaaaagatttgatttgagcccaattgtggtttcaatttagacatatttactgtatttccctacctgctcagtgtccctccctgtccctccaaggcttgcctggtggctggagttaattggatgcataaattcatgcaaaaggactaatggaaaacaagggcttatgtgtactgtttgcaatgtagtagcaagaaagaattgctcaaaaagtagaaatgttgacatatatgtgtgaattttggattcctagtccttgacattgcatcatgatagattgagggcctattttggctagaggaggattttgatgctctttacaatacaacaggaaggttgtttatcattctacctatgacctgggcttagtaatggagatctatattagtttcctagggctgctgtaacaaacgatcacaaattttatggcttaacacaatagaaatttattatctcaaagtccggaggccaaaagtccgatatgtttcctgagccaagatcaaggtgctggcagggctgagctccctttggaggctctaggggagaatgcatcttttgccccttcccacttctgatggttgctggcattctttggctggtggccacgccactccaatcactgcctccatggtcacattgccttctcttcttctgtctgcaatctctctctgacacacttataagggcacttgtgattgcatttagggcccagctggctagtccaagataatctgtctatatcaagatgcttaatttaatcacatctgcaaagtctcatagaagataatattcacatgttcttgggaatagaatgtggattttatgggagggggagcattattcagcctaacacaaagactaataacaaattactaatgccttcccctgacatactctcctcagccccttggtttatctaagtatgaaggagacaactggaatagagaaaagcaaaattttgcagaagatgccactagactttctttcctcttctggcccctggtggtatatccagctgcagatctgttcatgtacctgtccggtttctgaccatacacactctgctgggaaacagtgcagtataatccactcctgaaattcatctttgccagttttcactcatttgggtggctttcgacctccacagcataattgctgacgcaggttgaaactttaacggggggaaagattgattggctcaccaataacatttgtctcttgggctggcattgagcgcagaggaaccatttatgcaatctaattattacgtcaattgggggatggagtaatgtttcccagatgccatttggcacctggaaagctgcaaatcagcactatcatataagaaacattaatatagaccattgattggattcattgatcctatcccttccccctaccgcctttagcttcttactttggtttggagtgaaacgcaaaagctttgctttgcttctcctagctgccatgttcagacaggtgatcggattgattagatgtattttacaattaaatgtacttaaggaatcatgtgcatttctgaatcattttcccctttcctgaccttgaatcattcaaaatatctgtggccagtaggactgagatctaggctccaaaggaagccaaaacaggagggaagagcaaggggcaaagtgctgtttgcaattcctgcatcctgagcctgtataatatgtcctcagaacttttcactaggcttttcaggttcattgttggaacagtttcttggtgttagatcattgtaagcccccaagagggcttaattttttatttttaatgattctttttattagtaactaagtaatctgttgggattaacctcaacagagtgcagggccctagagcccaaggaaagaggatgttaggatattggggaggtttattataacctctttaatcttcatttcccttccacaaattcttttccctcttgtaggcagatccctgcaatatttttaagtgacaaagtctttcattccacaattggaaacaaagcttaaaatgtagctaatccagggagaaggaacatagctacttaaatttatactaatgagtaaatgactgctactacagacgcctagatgatctattagatttggaaagggcttcacagccccgagcctaaacttgttattttaaggaagggaggactgagaattgacttgcccaaggtcttacataaattttgaagtatagttttttttctgaaagaaagttttaatagaggagcaccttaaggggcattgtaaacagacatttgtgaccagttttaccaagggctaggtctgggggattccaaagccaactataatctcaggtctatttttaaaggtagtctatcaccagtgcttaaaacacactcttccctttggctctgccctggtgggattcaccaaaagttcatgtgtcttattcctttttgttatcttagtatctagttgagtgtctgcctcacaaaaggcattcagtgagtgtttgatgtaagactgaatgtttccagaaacagggaaggcttttcactgtaccctccatactctctcattctgcctcctgtgtacacattgcttaaatagctgttcaggttagagattttgcccttgggtgggactaataattgtgtcaatgatcagagaccaaagtgaagaaggctatccaacttacccaggatcgaacccacaaccctagacttccttaaagcatatgaggagatagtcagactatagtctgagatgttagaagtgaatattatggaatccatgtatctctgaaggccagagtcaccaagtctatatctctgatcattgcgggcatcctaagtcagggaatgcaggttgcaagtgggagccggcacaccttctccaataagcttctcttactttcttgggaggaacccctccctggttgtggttggggctacagagaaagagtaaagagggaaccatagggttgtggacaagctactcagatactcatggcttgtgggaaggaagggtttgatcggtcaggatcagcccttagctttaatctcatagtgcccatgcccaccaattctacttgcttattgtctccttcgctggttcacctgcactcacctgcagggactgggcccaggcatggcccctggccccaagcatgcctacctctctctgagctgactcgattaagtcccactgctcatgccttctgtgttcatggcaaaagttttcagtcagggatgacaatgaagagacaaggcagcccttggggcagggctacccatcagccctagacgaaaacaagatccagcagcaaagcccattcctgttggctgatggcttggcattggctgagagtccagagagccttcagttggcctgaaccaatgaaaaggagccaaagatacagtctctcttgccattaaagagatatttccacctatgattggccccaggatacttcacctcagggttctcctattggcctggaatagcatgctggcagctagggcaccctgtggtgagcaggcacctacgtaggcatgcagtaaagcacagcctgctgctgggcactcaggggacaggcagatagaggaggaggtatcaagatcctctctctgcttaactggtgacatcttggggtccaccaacttctcctttttgtgcctttcccctctggctgggcctgcttgctctcctggtcccattccccaaaggacttcgattcccaggtatggtggtgactggcaacacagggtaagatgtagctttttcttagggttatttgcattgttgtaggggatcctgaaatctgaaaagtggtggtggtccaaagaaattataggttcatagaattttggtgccaaaagggaactttgaaatagttcccattttacagatgaggaagaaaactgagatggactccaagaagtaatagaatttagtcaaaatcatgtagctagttagtggcaagtctcctgaccataggcaaggacatttctgatgcatcccaaatgaatcttaaactgtggtatttcatgtacatttctactgtttttcaaaccactgattttctgtcctaacgaaactcctagcctcactggggagatcttcagatcacaaattaatggcttaattaacatttacaacaagtttttggctgtgtcttcagtgtatgaagaagggggcttgtgacatgggctttctctctgtttaccctcttcttgtaccaacccacagtagtcagatgactgtgaccagggctctggagtcatgtaatctgctatctagctaggaagttgtccaactggtgactctgtgatgtttgagccatcactgtgcaagatgcagcagagaagcaagtcagttactaaatgcaaaaaggtctgagtctaagctactgccatattaataccagtgcttcgtttttcatgcatttagcctccaaatcccctttaagttagagacctgggtttatttgttcatatattaggtgggaccctgaacagtcctgaaatcctggccctgggtagctctgtattatcaacaacaatgataagtataaagggtttgggattactcaatccagctttcccccattgtgtctgttttcttcatgcttctacctttctcattccccttttccttatcctttaaaggccaatttaagtcctgccttctccaggagcctccccttactagtgctgcccacatcagtctttccctcttttggcttcttactgtccttccagcctatccctcaaagtgacatttcattatattccatttgtatttatcactattggttccatatatatcaacctcatcttctcaacaagagtataagttccataagggcagggtacacattttatccttgctaagtgtgccccacaatgtctgatggatgttcaaattagactagaatgatagcttttgtggtgacatgggaaatgctcacaatatacttaagtgtctaactcaaaatacaaaagtctatgatcacaattttataaagacatggaaaataaaagcaagcaagcagaaaggtaatacacgcaaatgtgtgagaggtgggtgggatgataggcaagtctaaatatttatatatttacctgacttttcaaagtttcaacaaggagcatgtattactcttatgagaaaaaaacaaggtggggtggggggaggggggagggatagcattgggagagatacctaatgctagatgacgagttagtgggtgcagcgcaccagcatggcacatgtatacatatgtaactaacctgcacaatgtgcacatgtaccctaaaacttaaagtataataaaaacaaaacaaaacaaacaaaaaaaaacaaagattatttaaaagagaatcatagatttatgagctctggaaagcagagcagaaacagatgaaagagctcacgtaagtcctgtcttattgttttaagattgaaaagcctggggcagagctatgggagatgcctagctggtaactcagtttccatcttctaggagcaaacaacccagtttcctgaagctctaaggctgagcctcctaacctctcctcaaatccaccttcccctgagcttctcctctaggcatcggtcctggaactgcgtggttttctcctgatgaggtctcccatgactctttggtgtctcctgggttgggaagcctgaaggtttggctttgactctgttctagtcccttgctagcctctcctggaactcactgctttgcctctgaagcatcccaggacaataagctatatagtatccacactcccaggtggctggaagtaaaaaaacacctagctgtaccctttcctagaaatatatacttactgcactctgagtacttgctgggaagggtgatctcgaactaattccactcaatacctttgcaaagccttgctgagagcaatactatttaaggagggccacctgaaattggtgcttgaagcccatccattcctttccaactggacccaaaagactagccccaggtacctgccatgcccataactttcccttctagttaggcctacctcactcatagccaggaaaaagggctggatggatgttttatgcagaagagtggcccagggattgccacttaaccccaggcaggccatccatgatctggtagcagacctatgtggtggatttttctattagtgttcctcttgccagcgatggattctgatgtgcccacaattggttaaagtgatgaagactcttgttaaatgcacatttgtcacttgagatgataaacacatgtaattcattgtgtacatctatgtttccatccttccatccatccaccaaacaagcattgggctcctatttcttattttcacttcccaaaccacaaagctctgaaaaccaaaaacgttctcataagtttgacattaaaactcagtttaacttatattataatagtctttctttatcccacttagtgtgaatgttcatatatttcatgacaaaaatattaatgtatttgataatggggagctatactgcaacctgctagaggtgttatgtgatattggcaaatacacatgattaccttgataaaattccccaaattcttaatttcgaaacatctggccctaaggatttgagataaggcactttaaccctttaagatctagggatggggaggtggtagataccctacctgagttggccaggaacagaagaaaccactcagtgaagggagtaggcattcaagtctttagagagagagggcttgctcaggttcaagccaaggaaatccagttgggtcactcagccattagtccaaaaggaaggaacagggctgcaaacagaagacggaataaagactcaggagaaagatggaactgaaatggaacaagaatagtttgagaatggggaaatgagagggaactagaaagtagcaggaacaaggtgtctttgactccagtcaattggctggtggctgttaggtaccaactggggtcaggttagctttaaatttggaagattgtgacaggcagatactgagagaaatgagacacaaactctcgtcctctctttgccaaaagtctagaatctgcagggtcctgagagaatggataggaattggagttgcattagtctgaaacaaagatttagctttgacttttttcaatctctgcatttttaaagctttattttttaaattgtgaaatatgccacacataaagaaaagtgcataaatcataaatgcacaacttgttcaatgaaacacccatattaatcattacccagttaaaaatagaatattatcagcactccaatgcccaacttgtgtcctttccctaatcataactcctttctcccctactaaaaggtaacaacttttctgacttttccaaaaatcacttccttgcttttatttagacttgtacaccttagcatgcatcactaaacattatagctttgccagttactgacttttatgtaataattcagtatgtacgcttttgtttctggcttctttcattcaatattatgtttgtgagattaatccatgttgttgcataaaactgatattgttccttctcaatgctgtataatattcccttttgtgaatatgccacaactgagttaaccattctactgcagatgggcattttcagtttgggactgtttgactaacactattatggttatttttgtttgacttttggtgcacatgtccctgcatttctgttagtagtggaatcactgagtcgtaagcacgtgttccatttgctagatgctgccagtttttcaaagtttgtatcaatttgcactcttccattgtgccaaatcattattaacagtaagtattgtcagagttttacattttaatcactctggtgggtgtgcagtggtatctcattgtggtttgatttgcaattctctggtgactaatgaggttgagcatcttttcatatgttcattggccttttggatatactcttttgtacaattcccatttaagtcttttgtccattttatcctactagattgtccttttcatattcatttctaggagttctttatacattctagatgcaagctctctgttatatgtggtacaaataaattttccaacactgtggcttcccatttaatgctttttgagtctcattttcttcctctaatttccatcaagcttcccaggctcaaatgtcccccattttgctaaggttctaacaagctcacctgggccctgagggatagctcagtaaggctgcagggctgttctctccaccttcccttccttcttccctcccacttatctgccctgtctctctctctcccttccctcaaattttgcccattcttggggggctgcttattattcacaggatggatagaaacaaccttcttttagccatggtgccaaaactgtcagatttgccaagtgctattaatacgtcagaaaaccttcactctggaaagcgcttggagattatgtagttctaatgatgaggaatcaaaagctcagagaaattaagcggcttgtccatcatactgcaagttagtggccaacttaggactagaactcaggtctcttgcatgcatgccccagctttttccactccattatgctaagaaagaccagagcacacagctgcacattggcgggggcatttttttcttcttctgaaaataagtgctgtctgtgtctgtgtaacaacgcaatcggtagagactatggctcatgtctgtctggacccaggttgagagatcacatcacctctgctactttcccatctcctggctgtcaaagcctgaaggacaacaaatggcttgagtaatgagatgagttaagatagtgtctcccacgctgagttatgtgccagttcaggactacaggattctgccacaatccatttacacaagaaattaaattgaagatcgcaatgtaatattcatatattaaatcctggcggacaatcaaagtaattaaggccaaatgttctgaatcatcctgtggcatcatgaacattctattgctgggtttttagaaggacttatttctacaaccaattatcttggaaatcattaaacctcctttggaatgtgagtaatttgaaagccaccatgatacccagtgctactcaaaccactttgcccccataaaagaataactctgctacataggagtgctgggtgggtaaggaaaatctgattttcaagaagctaagtttaggggataggaaccagtctccgaccacccccctccctgcattgtgtttttcaaaaggagtggctatatttcatcctaaattgaagcagttaactgatgcaggctaccaggctaatcccagctacagactgatctgcttgcagtgtagttctgtggttctcacaaatacattctactgattaaaacaaaacaaaacaaaacagagtctggagaaagaggatggctccgtctagccccacaatgatgaatagggttgaccttcagaccttccccaacactccccaccatagaccactcgtctcttaaagcttctccacataccctcatctcttagtccctgttcttctcagcttccctttgtccacacctctgttatgccactcatcataaagtcctcgagttatttgttggctccccttctggagcgtaagcccttcaagggcaggggctatgctctaatctttccagtgttcccactcgtggcccagtgcacgcatcagagaaggtgctttgtgtatggttggtgcatgtatgaaagtctagatatataaaagacaaatgatcaagagaactcacaaacatacacgaatgtatctctgtttgggaatgacaggcttagtgtcatggcagcatcaaagagaggaaccaatcttcctttctcttccagtaaatgttttaattctctccaaaatacaatgctctcaaaccatcaccaacaaataaaactctatcatggagaatgtgtaactaaaagataaacaaaaagtattaaattaacttgtactttttcagagttgtacttaggaaacaatcaagttattttacctgaactaattatacgacttctttgcatcttgaatactgtatacaaaaaaaggtctctgattcatcagttttgccagtgggaataattaaaagtgtgcatatacagtaatattcctacgaaattatttcttctcataaatatttatccatagcctaagtttgttgatgctgagcggcatcaatatttcttgactttggttcacatactgcccccttgactgtaccacaattctgattcacaaatgagattcttgggagatattggactgtatcttgttcatgtctatattcttagttctagcacagagcttggcacagagtatgcactctctgtagaatgaacgaatgaatgaaatactaagtgaggcagtagccttcagggatgatttgtatcaaagtgaagttgtacaaagcaagacccattcactgctattctctttgtgacccgttggctacagcatccctgagcttttagggcaacccgatccacccacccaaccagcatgcccctttcaaaggcagtcgtgctacccctccatgtgcccagcactagccagagaggttggtgcagtctgtgtgccagcccaagccaggtggacacagcgacaaccacctgtggctttcctgggtgggcatcttgagcctacatgtttcacgtcatcatgcacctaccagtcagtgctggaaactgcaccaagaaatattgatactgcacaaaatcaataaactggggccatggctaaatacttattggggcagacagtgacgccgtttgctcagaaaattcaatcaagttctgtgcaattactgcgggtttagattcgaacaaattagctgttagtcatagaatttcagaatgtcagagctgaaaggacccttagaattcatctggctctgtgtaaccccgaggttttcaagcttcgctttcgcaagaaacactttttaaccaaggaaatcttatgacgttcatcttattcaagtaggggtgcggatcctgatgcatagcctccccttctcaactgcttcaaactgcagaggtgaaaaggaaggtccagtaaagttaaggaggatcgtggcatactaggggcaaaaagttccagtcttggagtaagtgtcaagacagactgcaactctgtcttagccaagggcctgatattcagccatttacactcatgcctgaaggggtcttttggatatgatcatttaaactgatgagagacgtgtgttcctaggaggggagacacagtgactaacagaccctagcaggagtgagtttatttaaatgaaacacactgctaccaaccttcgcaaagcctaaaggaaaatcccaagggcaggagacccagaatggtaaatgtccattattagagtatttcacaaaggcaaagagaagagaggaggaacggagctaggccaaacctcctcctcccatcctggcggatatctgcttgtgtacctgtctattcatgtgtccatcttttaagatgcctttatgtcatcttctgcagtggtatatctagttccttgtcagtttctgcctgaggcccattcttgtgttcaggttggctctctctactgtgagtctgtcgctgcctacatctcaagtctttcagctcctctgtgtccagatgtactatttttcatgtgcttatttgcctcagaatgtgtgtctgtgtctgactgattttatcccacaagaatggctaacagtgaaagtgggagggagggaggaaaaaactgtttctggtcctcctaaagacttcaatctcctcttctatgtttcttaacttttttcacctatttttttcccagtattcatatctccctcatccctttttctttcactgtgttcctttatctctggttgttctatttttctgtttctctgtatacttttcttttctattttatttgtttcttcccctttctcttcccctatttgttttctctctagatttgtctttccccatatatttccccttttcttatttttttctttctctatatacctttcccatttttggggattctttctgagtctgcttttttctttctttctttctttgctttttttttttttttgacagtgtttcactttgtcacccaggctggagcacagtggcatgatcatagcttgctgcagccttgacctcttgggctcaagcaatcctcttgcctcaccctcctgagtagctagaactataggtgcatgccaacatgccttgctaattaaagaaaaattatattgacagagtcttgctatgttgcccaggctggtctttaattcatgggctcaagtgatctgcccacctctgccttccaaagtgctgggattacaggcgtgagccaccgcacccagctagttctttctctttcttcttttcctcttagctcctatttctgggtttctcttttaactgtattcctcttcctccatgtgtctcttttctgtgatcctttatttattttattcattttctttccctgtcttttttatccctttctccatgtcttgtttttctatttctctttctcttgcccattcttctcatctctctgtcagtagctccttgtgtatgaatctgtcagcctcttttctgctttgttctccccaaagatgcttcaagcatcaggaggaggaaggagttactcttttctgccctgggctggactgtgggtgggtggggttcattatctgtcttttcactcaaggatgggtggggtcgtttgctgctccctggaacctaaccaacacatccttgttccccgcccccaagaccccatctgcagagtcacactgcgactccagctgctgcgctgcttgcattccctgcacgtcccatgcagagtgatgagcccccaggtgcagtgggagaattcatcagccacctgacagggctaacaatttactcctgagaaataatccatatccagataatggatcacccctgactccctgagaccatttgtcttggcacttaaatggcaccagaatccaggggcagagccaggcactctatcccaggttcattggtagatgaataggctggaataataatgttaaggattatgataaggaacactttgcatttgcatggtgcttttttaaaactctatagatttggaagagattaaccttccttggctcatatcttttgcatctcacacactgtggaccctgcttgcagattcagaaaaaggggaattttagtgactcacccagactcatctagcctgttactggcagaaattggaggaaaactatttcctgacttcctgagactctttcctctgaatgctacacggccttccaatctctgggtcccactgtttgtatccaagaaatggaagctgatactaagagacagtatactggagaggttcatagatctggctttgaatcctggctctgcattagctaggctaatgcaggctgcttactcacttagaaattctactttaaagatcctcctctttaaagtggggatccaaataaaccttcctcgtaggactattatgagaatgaagagaaattatgcatgcaaagtgcttattatagtgccttccttatagtaaaagctccatgaatgttagctgtgattattactactgcctgtctctttgcaggatgctaagtgaactcatacaaatgcatgagaaaattggtctagaggaggggaagagataattggtggcttccacataagtgtccctgaggccattgatgggggaagggacgaggaagagtgaattctgattgcgggaggaactacggattctgcttggggtgggaggtcccgccagctctgggaacaggcaaagagaaggaaggagattggggatttgtgttcaggctccaaatgtatttcattgctcagcaggatcaattgttggccttcagtcccagccagctaaggttcccgttctcagggtctcagctgtttctgtttccctggggtggttctctttcccaaaagctggacagaggaatatttctttgggggaatattgaagcccaaaagattttgtggaaggccagcacaaacgaaaaaaatgaattcttgtgcaggagccttttgcgtaaacaggagttcactgtacgaatgtaaaaataatattaatattcccaataataacagtaatgatcaatctttaaagcttgttctatggagtgccactgccagaggttgacacatcatctcagatggtgcgaaacatccccagggtccatctgcatgcagaatcacagcccacattcttctccccgtttacggagacctcaccctcccagagtcacacacataatttagtcttcggtgaaatgattctgacgctatagaggctccctggagaatggatgctgtgcggaggcgggcagtgtgggctcctgacttcaagctgcaggaaggcgaggaattgatacatctcctaagctccaagggctcaactcctttggagatcagaagggctttgtcaaagcctgacggtttattaataattctctcaactgaagagagccccatgcttatcaattgacaagtatttagtgaggaccctctgtaggggagctaaagaggtttggcagagctgacaatgtggttgaggagacagaccacagacatagaaagattattgacaataaaagcagtcccttcaacaaagagatgctagcagctgaagcatctcagctggaaaaaaatgtagagtcaggagatttgacctcacaatctctctgagacttggtttccctatcctcttagaaaggcagtctggtatcacttaaagaatattcactttggagtcagaccaacctgatttaaaatttcagttacctcacaaactaactaggggtcattgaaccagttacttaactcctatgaggcacaattaccttatgtataaattgagatataataatagcccccacctcatagtgttgtggtgagaattagatgaaagcacacatgtaaaatgctaaacataatgcctggcacatggtaaacatttaataatctgttcttcttattataatatgcagggagaaaggcagagaatgtttggaaatagaagggttttattttcctcttcagctttttatatgcatgacattaaatttcatacaaatgcaaaccaaaaaatactcatatgtaaacaataattataatatcactgtatgataccttttatatgcctccccagtattgctcactaaattttgtatgatcaaatttacagaacaatgaaatagcagaggaggcaaattatatgctccttgtgatcttgaattcctttctgagcttcagttttcccatctgtataatgtggctaagaacacctacttcacagtgctgttgtgaaaattaaattaaaatatgtattaagcacttagcacagaataggcagaaaacaaacattagctccctcctcttctctcatctataaaaatgagaataagaaaaaattatcctcacagggttatgatgaggatgaagacaggcaaatatacaggaaatgcttgtaaactgtaaaatcccccataatagtctttacagaacatttgaaatgtaccaggcattgtgcaattaacaaacgttaatcaattaggtaaacattacttaagtgtctactatatggaggacactattttaggtattgtgagccatccagagagataagggccatcagagtagatgagcccctccacataagaatagagcgttgaggacaggacctgagcaatgctcccatttagggtaccaaacgagaatgcagagccagaaggagaaatcagaggtaagaacaccagtatagcagtgtccgcagagccaagggaagagtgagtttcaataaatagagacttacaatgtagcattctgcagagaatgaaaatcaaaataggacagagatgtgtccccttggagcaggcctccaaaaaaaacattcgtaactgctttgagaggggctgtgtgtgtctgcacgtgcatgcacgcacgtgcatgtatggagggggtaggagccatcttgccgtggatggcaggtatgtttggggaaacgtaaggtgagcatatctagaatactctttcaaggtgttaaggactaaggctgagaaaggaagcatggatgatagctagaaggggacgccgggttgagggaagactgtttccatataggaacgtttcaatgtttttgtgggctacagggaagaagaagcccacagggaaagaaaagatgaataagtagatgacagagaggattactgaacagacagaagaagaattctgagagatgagacctgggaggtttggctgagagcagaggagttttcaattaataaggagaaagagatcatggggtagcaaatggctgtcaagtagccaagagggctgagagttgacaaggagccattgcatctagaattaggaaggcctcaagagtggaagtggagtgggaagaggtaaaatagtgagttgatggtagacactacacatttgagaagttttgcagacccaggagcaggtagaacaaggctaagggagagattatgctttacggggaggtttgagatgtgtgtaggaaggaaggagttagcggaagagaagaggctgaaggtagaagagggtcagaggtttcttggtggctgaggtggcagcagcagaaggggccgagcttcagaacactagtgaggagaaccccagagaggatcccttttttcctttgaggtgggaggaaaggacaaaaaagccagaggagccgacgttctgcacttggtccttgaacctggccttgggcactaatatcaccactgttgaccccataactttcagggcatctcatgatcactgagtagatttgagggactgtctctgaggacagcaaggtgtgtgatttggagaatatactggcggctctttccctagggagatggcagagagctgtagccccagtcccaggatacaaggccccagagcctggcccagtgaggagggcctacagtccatgacctatatccatgttacacaatctcttccttccctgtcactgaaattgccaccccagagccaatcttaaaaatgaagtcagggtccacagtcactcagagacttaaatgttcctgttatttgctaaggcactagggacccagagtcctgtgatctggccagaaatttccttattaggggcaaaaggaagggctttctgaatataacctggtcttcccctcttcaacatgtgtgcacagcctgccaaatgcgtcaaatggccgtcctgccacttgacccagcctcagctacagcccctcttctccagcatggctgctctctggtcataggcagatgcatctctgatggcaccttcctgccttaccgcttagttttcaatctcataactctcctgggatctggggggtggaacagcaggacggttataagccctgggtgcttgaaagcaggagagggttttgggccacagaagtcaggagagggggtccttgggtgggggccagacccaaagtagctcagaagttaaagtcagtccttggtatcttttgtcccagggtcaattttggtgttcacataccaatcttatggctcctgggatggaggaatacagggagggaagggcaaacagccccttagttagggaaacctagggctctggagctagccttgcatctttgtttaaggtgtgggttgtcccaggattgagttataatggagaaagacctatttgcattgacaaatggcacttaatgaagggaatgattaaaagcgagggaagctacaggctcagaaatgtcagcggttgttgtacaagagaattcttttattgcactttcctctcccccttctccctcgtcctttttcttccctcccgctattgctcatcttccttcttctcctctgccctcctcctgcttgctccatccacctccacccacagcaactgatgtgatttctcatgatctacagtcaaatgccattaatcccgacagactcacgagggtccagctaagctgtcccatgaaccaatcctgtgagaagacagaccagggtacgcaacgggcaggcagcccccccaccccgccccctcacgagtaatggcagataaaccaataaaccagagtggctgcccctaaaataatcaataaatcacttggggtccaagagaggtggaaagctccccagcaaacagtgctcaggatattttccattaccttctctgccttgaatgtccatggcacgctagccgcgtgggccaggactgactctgctctcaaggtgccgctcccagattccgcctggccctctcagtttcagagggaggtaattcattccagtgggatgtgacaggtgccatcttcaggcgcccggctctgctcccagcagcagggactgtcactgactgcaaatcccccaagtgccacgctggtctgaagaaagcaagccctggggtgggcagatgacctttcaagaacccaggaagccaaagtgggatagcagcatgatgtaatggaccgagccctggactaggatgctggacacctggcttttagtcccttttcagccactaacttgctagatgatgttgggtaagtcactttccctttctggatctcagtgtccccttcccaccagcccccgtgatgtgaagaggttggactagattatctctaatggcactttcaaccctgataagcaagttttgaaattaaagaaaaaattatttttggaaaattgccagctctaattagaatttgtttaaggactcctctcaggctctaatttaagctgctttaccatcaaatccttcaccctaaactcccatgcagtacaggcagccacttaccagcacccaagctccatctaagacatcacaaccactcacaggtgtagccttcccctcctgcagagctagttctgtgtttggggctgggtcatcctgatagggtcctgaggtagagccccatgagatgcatgcaccactaacactcagattttagcgtagaccagtggggtggctgcctgggaggagattctccttaacttatacttgtgtgtgtgtgtgtgtgtgtgtgtgtgtgtgtatacataatagcacaataaattatctctatctatatatatatatatatatagataaagggagagagaaagagagagtcatatatatatatatacttgaaaatatgttgcagatatcatgacatttcactcctaaatacttcagaatgcatctcataagaataaaatgttcttagctggggagtttctcaggctttctagggggtttggaattctcagcaaggtgaaagtctccagtttttggagtccaagggaggggtcaagagacatataagatctaaagaccagattttaggctggatatgggtagtgtgagagggagccatgtacaaaagaaggaagcacaaaagtgcttcaagaacaggttccaaacaaacaaaaaaggcagtgactttaggcaagtcactccccttcctcaaactttaatttcttcctctataaaatgagggttgtgctaatctctgtcctgccaacctcccaaagctgtatgcaattcagattgaaaatacatatgagagtacgttgggagctgctacacttaaatatataaaggcaagtgctttgcagagatgaacttcagaggtagtaaagcccatgagtccatggtaacacatagaagtggacggtccccctgctgagcccctaaactcttgttattggaagccacagaattttcttctagaatggaaatgtcagtggcttgcatgtcttgtagtttttcaaaggcataagcacacacctgaattttttctagttcttttttcagataactccattttcttattgattatggcgcacaaaactgaaagaaaacatccctgtgctttttgttctttctgacattttttcctgtgcccccctttgttcccactattctccctaccccaccctgttgagacttctggagttggaaaattctttcatcctgcctacccctagctcaaagagcaaaatgctttacaaaattaagtgagcatttgggatttttaacttgattttatcttttcattcaaccagaggggtatgtgtgtgggagatgcgcttgtcaactaaaagcaatttctctgcctccttggggactgaagcgtaatcgttgctctgtctttctggtgtcaggatgaaacctgcatttcctgagtggtgtcagcacactgacagacagctcctgggatctagcaaggagtaccggaaaagaatgggcagggggcgagagatgtggaggctggtctcagctcatctcttctcccctgggtgactttgggatagtcacttactttgcctcacttttctaaatctaagaaaatgggaataattctctcccatatctacctcacaaagatggtgccaggactttgtcaggtttcagtgatatgaaaatttagaattaatagagctatgggaaaaaagtgctatggaaggagtgtacccctagaaatgctgttaagtagctagaaaggaacttcaagatttctctgtataaacccatttgagaaatgaggaaactgaggcccttctgaggttcgaagtggtcccccaaagcacccatgatttcactgacatgtttaccatttgcccagctaagtctttcacaaatagaaaaccagggaggcagggtcttgaggtcctggggcttggagtcccctttagagagcaaatatgatccctgtgtgctctgtgtggaccttctgatagggcttctcaaaaggagatgctggggggcagggtgctaatctgccaattcccttcatggacccagaaataagtactttgttatctcgttcctgaaaatgcagagaccttcctaacaatctgtagagcagaggtgtccaatttttttggcttccctgggccactttgggagaattgttgggccatacataaaatacactaacactaatgatagctgataaggtaaaacaaatggcaaaagaatcttatgttttaagaaagtttacaaatttgtgttgggccgcatccaaagctgtcctggttgcatgtggcccacgggccatgggttggacaagcctgctgtaaagggaggtgggtggcaggactgagattcccacttcatggaggaggagcctgaggctcatgttgggaagcagacacacattcacccagccagtcagccagtaagtccagcctcactcttggcattttaactgccctttccactgtgctctcttgcctgatgcaaggaacccaacaagtagaatgttcaaatgaaataacctgactgggaagtgctatgtagacatatacacaaggattcttagaaaatccaaatgaatgacttgtatggagtatgctcattttgaatacacctaggccttatgaagagtcaagtttcaaggtttagtcaattttccatgctacatatttccccatgcacccaaaagaagtagagtgggcttaaagtgaccagtttccccatttggttgccccagtgtttcttgtggctagggtgccgcagtgttccctgtagctagggtgcaaggggagggtttgcagggaaagacttctttcttctatattagagtttctctaactttagtgggcgtaaaaccaccatggagggcctgttaaaaatactattttctagtccccatgcccagaaattcttgtttagtaggactggagtgggagcaggaaatctgcattgttatatgacattccaagtgattctgatgcatctggtccaatagattgtactttgggaaacactgatcaacaacaaggtttaagggcctttaattcctagagtcccatttaattagcaattatatgcccgggtgtcaagcacttttgggcttcaggaaaaaagttaagaaggtctgaagcctatcttctaaaagtcaacaagccccagattcactttatcattctggctaaagacctctgggaagacaatgacccaaactaggagcaggatgcttggctcttaattggaattacaatagaagacgcttaagaagcagtaaactgtcgtgccgtaggtcttggactgtcagagtgaggacaaggatgtcctatgtatcccttgtgagcacataccgtgggatgagggattacaggtccaggctagcaggctcctggctgctcgatgggggcactaaggactcctacatcctcagaaaggaggagtcataacttgttatgtgcccctgcacaggaggggaattctgcgttttactcgcaggccaactttctcagccttttctgggtcaccaaagccagcccaggtgccctgtgccactggcacaaccccaacctaaaggccctcgtcattctcctatctagcctagtcctttattcagcagagacgaagttgtagatttttttctaagtaggattttctaactccagaaaataatataggtttattaaagaaaaattggagaatactaagatatgaaaataataaaacagttaaaaattgcccataattgcattacctaaatacaatcacgactcagattctggtgcgtttccttttagcctttttttttctgtatataggcttattatttatttgcgctgtctatattacaatgtgtgcacattttgcatcctgcctttttttcatttaaaaatatcatacgcgtattttcagtttatcatataagcttctgaattatacacttaaaaataattgcataataattcattgagtgaatcaacattatttgcatagctcaatatctggcacctagaggacatttgaaaaatatttgttgtatgaattaatggattgatggatgaatgcatttccctattatgtctattatgcccttctaccccaggaaatttagttaaggataaagattttcaaaggtaatgtaacactaagtaattaagtggcagagtaggcaggtggtcaaagaaaagggacagggcagaactgctaacttagttactaaatcaattttttaaagaattctgacctctgtatttcctcttctcttttttcccaaaagagtagatgctttggtccacctggagctttttcatagctattaatatccccattttacaggggaggaaactaagcttcagagagattaaataaccctcccaagattacatggctagaacatagcagaattgagcttccaatctaggtttgtgagtttctgtagctttgttcctttattacattatacctcttgagaaaaaggcaacaaagaaggacggctgtcatgggtttgtacctcatgtagagctgccttggaagcagagcaatttcagtttccgaggactctgggattggaccaagcaggcagattttgtgccatgagggagcccaaaaaaagctcattcagttggaaaaaaaaggaacccattgaggccatttcaaaagctggtgctggataagctcatgggaagaggtaaggctgagatttcaatatccagggcctgaaactggacatttctagatgttaggcttgtttggcttggatgactaagtattcgtaaagaagaaatcggtaaaagagcaggtctggtgagtgtttgttgtctgtgattgcttttagaaaacagagaaaatcaaaatgatttagaagttggtacaaaggcagagaggtaccatttttcccagaaaggaaggaaaacaagtggagggcctttaaactctgaagatagctctgctttgctaagaattgtacagcaaagtacaggcaatttttccattttatgcaccccttttgccgcattaatactaatatcagtggttagcaaagcaaatataataactgctctccccagtggacccagtgattgaggcttccactcctctggcctgcaatcgaactgttggaaggagattttccatatttctttctacctcctcactagcattttgatcaacagagccccattctcccagtggagaaaaacaaggcacagagtcacgtctgtggagctaccactggcgaattgggagagaaattaatttgggcccctgggcttgaagtaaaaaggaaatttcgtttagaagcccttcctgcctaatgtggtccatctctggtggctgcttctaccccaggatttggggggcagggctctttttaccaccaccagaggccccaaacactgaacccattatggcacgtgcttccatatgtatttaaaacgtaaaaatacaaagccataaaagaagtgtaagaaaatccaacacagtaccaccctccattgaaatatcaaatatcaaattctttctaaaaataaatgtgggtccccctcccatatcagtgccctgagcaaaagcattggcagtggaatctgtaagtcggcagcaactggggggcaccccacgtttatacatacttgacactgggttcttttatctcagttgatgatcaaccccctcagtacaaaggttcccaggcaggagagcatctccctcttcgctgcggaattcgcaggagaagggaagtaagattactctcagatatgggacttcttgggggaggcggcaaaatcgtttttcctgctcacattcttggtcctctagaacggaccagtgatttaaatcagacttggagctactcggggctgaggtgatgcctgccctaagagaggggttaagggtgggggtgggagggtccccaagggctgagacagcatctcccctttagattcagggatcctggggaacacactgcttcccgcttagactaggcctcttgagggctgagataacgctccgctaaatcgtggagttttctagagcctgggatactgtctcgctctcagatctgaggctccctgggacaggtgcgctacctcgccttcaaattccagcctttgggggcaggcctgcttttatgtgcccgatcaagggctcctggggtggggctgggggacaaggaccttccctccctctcagatttggggctcaccagggctgagatggcgtctcccctcagactctgggctccctggggtaggggcagggtcccgccctcagaatcagcttcccaggacaggagctgtgtgtctctgcctcccttcgcgtggggcaaggggctgcgggaccagcggcctctcttctggcaggagggggggttccccggaggccctgcccccttcgtgacatgctcgaggtgtccggtgaccgaaacactcttagctgggtgcagggtgcggctcagggcgtggtcaccgggggctacttagggccgccggtgcgggggacgacgcaaaggttaactgcgagctgccgggcactcagcgcgggtcatggcgtggatactggactgccttttcgcctcggcctttgagccccgcccccgccgtggtgagtggggcccaccgagtcggggggctggggtgctcggccgggggcggccggcggctgcagccccctctgggcgccctggggcttggctggtcgcccccttgcctcccttcctgctggcttttagctaattgttcctggctcaagggactgccccgtcgaggccccgcataaatcaccagctttgccgggaaccgcgagcaatcgcgctaatggctcggcggtacgcgggacgagcgcgtgggcggagtcgctggctcagccgccggcagggacagccagagccttggggccagacgcgcaggagcggcgtcccgcaactcaaggaccctcaaggcccaaggatgaatgtccctgacagggcaagccaggccccagggaccctgaaggaggcgggtattcattttgccttgaagttcgtccccttgtctcaatctcaaacacagaatatcagcaatggaccccctagagtcgtcgaatttaaccccttcatttaagagatgatgacactgaagatgggaaaagcctgcccaaggttacccaacaggttggcagcatacctgggtcagcttaggctctgccagctgcccactgccccagactgcccagtagtggacccctgcggtctttagtcgggttctttccttgggtacttgagatcaatgcttggtttccctatttctgtggaattgaggacacaagtgtgcaaagatcacagcaccggcatatgtgggtcacatttcaccccttttcgggaactgcttctacaaagtacattttgacaactgattatattttcatccttaaagtttcaggagactgatattttctttttgacataccccaggacccccacccacactgtccttcactcccccttgataataagccccacccccttcaggctgccacctgcccccacagccacctgttttttcatagtctccacctccaaaatctatattggtgagagtgcgtcattgggcaccagccatagaccaaacctggggttgtctcctctttcctctgtcccttcacaggcgggggaggggaagcagggaaaggaggggcctcagcaacttaattcagcagagacctgtttttagttcttgccagccccaacaccctgctgagaaccatcccaggagtttgacctcctgctgaaagactacagcttgcttaggcagttcaagtacagcctcaggccagcaacaagatctctgagaaggaaaaagatctgcatacacacagagtttaattttttcttttgcatatttttaaggtttatatgatcctggtgaatcaaaaatataagggagttttataagatgtcttttaaggccttactgctctaacagtataccctgaaaaagggggtgggggaaacatttcacagttgcttggactagaaggttgtcatgtgactccaatgagatcaaggacatgaaggctcctttatgagtaaccacataggagggagtccatattacaccaggaagcccattcccatctaaaaacagcaatgtctattagaattagaaggcttttctttaaactgaacccaaatctatgtcctgggaacttccaccttctggccctggcattgacttccatggtcctccttcctaggaaacagtgtcagctctccccattgtcccatcccctactcaccctgttcttacctaggccaaacttccccagtttcttcatctatttaacatgtgacatagcttcaaggcccctacccatgtctagctgcttttctttgaacatgctccaagttataaatgtccagtgaccaggccaaaagaggctttccagctgtgcccctataaatatagtcctggaaagctgactttccctcttttagaagcctacaccacacccaaggtacacacatacgtagtcataaacacacccataacatacacattaccacacctatgcatgcccatttgcaaagccacgaacacacacacacacgcttcacatgcaccacatactttccacacacaacacaatatactcacatcacctgtgtatgcaccactcacaaatcccatgcacagccacacagttcacacaaagactttattcacattgaattactttcaacgaaagctactctttttccttaagtaaacccaagttctttttggagtctccattctgtatttggtgtttgaactcaagtgtaagaccttatattcgctgctgcatttctagtctggtggtacctgttccccaacatacccctgcagcacaccactgcctacatcagctctattactcaaacaacagcagctgatatatgtgaagctcttcccaaatgttgggcccttaggctcaattgcttacatgtataatctcacttaagtcacagggcatcactttgaaataaataatctttgggtagttttttgactgggcaacagctcatttcattgcactccccctgagaaatgctgtacaatgtgaagggtaactttgtgggtaactattgatattctgcagggctataattgctttggtgcctccctttgaatgtccttcagaagtcttcaggagtcagagatggggttgggggaggaagctgtcagctgactggacagaactggggcagtatctaaatgttccttcacccccattccccttgcccaagagatagctggcatgtgacagcaattttttttttgaggggcaggtttattttgtcttcattagaatatcatcactcttttgttgatgtttgctatttttttttttgttcaactcttttttaaaaaaatttactttaagttctgggatacatgtgcagaacgtgcaggtttgttacataggtatacatgtgccacgttggtttgcatcagagagatttttcagggcgacaacgggcaatgggcaaccataggaaggcacttgggagaggcatcactgaggtctgggaggaatgagggcccagaaaggccttctttcccagggaaagagacagcacaattgacccacttgaaattctctccccagttcactcttggcattggatttggcctcaaacaattggacttctgtaaagcagccaaagctctaaagctgaagggaccctggggcgcactttacatacaaatttgatcttttcttggagatgggaccgaatcgatttgctgaggccaggcctagttgtgctgcagcaggatcagtttccaaagctggggcgtgactgccaatgagaccaatgagacaccccattctccaagtcaggtcgtcagataagcacccccattcaccaatggcaggacttccccaattttctttattacttgtttgtacctcaaaatacatttctcccaaagaaaaaaaatgtgatgctctagagcttagcccataccttacccatcgtgaggataaaatacagaatctgtgtgatgaaaactggcagaaaataatactcttgcaaatatatctcaggctccagcagtagagctgacatttatcaggcttaaatatcaaatgatggaaagcattgagcactgatacagcaaggcaccaggtccgtgagggtgattatggcaatggtgaaagtaacatcattccttttttttcacacctacctactacaacaacctaaatgtccaacaatagtggaatggttaaataaattctgtgatatatccccttattagattgcacagaatcataaaaattgtttttgtgaagaatatgtaacaacatagaaaatggtatgattgtaactgtcaaatatgcatttttgaaagactagaaagaaatcgacaataagataaagttagagaatctattaaggtggtgggataatagttatttttctctatgttttctaaagtctatgaagtttgttcttcaattactgttataatttaaaaaggcatacaagggtaaatttagtacctgtgatatgcaaataatctatacagtgatctagaatttcactatacatagtttaaagaattttttctcctaattttagtttaaatgtaatgactagatccggccagccaaccatgatcttcccaatgatcatgaaatttccactaactctgggtgggaagaggaacaactggtttgaatcccaggccagctcttataaggttgctgtgagagagttacttaacctctcttaaaatgacataataatgtctatattttggggttgtaaataataataatagttcttattactgctgttgtagatgtcattatgttaaatgctttctatggctcagttatcaaaagaagcttttttcccaaatgtttactatttgtaaataccagtcatactacataaactatctctaaccataacaactttctgaggttagtattattgtctctattttaaggacaaaatctcagagaagtttagtaacttgcccactgtcacacagtggctgagcagggattacaatcctttttgatctgacttcgaagcttgagtgaaattaaaagagagaaacatttgcaaaactcctatgctgacatatggcagacatttactaggtggtcaacatgatgttggtgatactttgcccaggacccagatgctggtctttgacttatttgattatctataaatttctttctgtgaaaaggaatttcaactgaaagatgcaatacaaacgcaccacctgtgtcctcatagatgtggctctgagtcactaagaaacgatttctgtttccttcggcagtatcatttgttctcacatgtatcagcagaagtaggtagatggcatgtttgatgagccttggcagctactgtcacgtctcagatacacttcctgagaaaccacgcggcttcctcgggatgagtactcaatactcagcagctggtaggtccctgcttattaaggaaacttactaagtggcatgggcatatctggaacccctgctctaactattctctgtctgatgtggttgacacctaattgctacccctcccatttcccttttcaaagctaaggctccaggatttccacagaagcatacaggggtaggagctggagaagtttttcgaaattcttaaatcctcagagggactcacttgcaaggaggaatctagggttagtgaaggtagcatgcaggataaatagaagggatgaaggagagggaggagttgaaggcaccttccagagtctgggaacatctaggggtggacctctcagagcttttcctgccatgaatctcaatacctctctactctgtagtctctttatccctccctgggattatatccaccaccaccacccctcccccgcccccaatttcttgatcttccaccaccgctccctgcttaaatgcagctttagcttgcagtgacttgcttttgtctctagagggaggcaaaagcaccagggaggagggggttcagattggggtcttcttccacttcactagttttggcaaagagtagaatttattttcctttcattgggaacatatgaataaaagctaatcagagatgtattttaagtgctgcatagcatatctcagagaaccatcatatctttctctatcattccatctacccctcaacgtaggtggctgctagaaactggatggtcttaggcactattatttctagagtgaaagtgagggcaaagcaaaacaggagtcatagggcaatcttagccaggaaatagtcatgcttttattttctggggcacaatggcacatatttaggagactgggttggggctgggtcagcaattggggtggagggaagtctggacagtgagcagaaagtttgaaactttcctgtgtggagtattacatctgaaaccttggtctcattaacactgcgaggagaaactgcagagtgagaattggacttaaggtccagttcttccggggctgcattaggctgatcaaacatcttcctaaaagaagagggactatttcaagagtgtcagacaagccagtaatgaggaaaattggcagtttagtcagttggctccactccctgaacaccatggttgagacactctgggctacatgagaacgaaaaaaagtgcagaagggaattaactaaccttttcttaaacatttactgtatctgttaaccacttggctggtggtttctatggtttacctcctttagtcatctgagcaattctaggcaggtgttaacatctccattttacagttgaggaaactgaggctcagagaggtgaagtatccttcccaagatcacacagcaagtaagtgctcgagctgggataccaacacaaagctgtctcattccgaagcctgtggtctttctctgccctccccacatggaaaaaacaaaagccctgattttcaagggctttactctcatggggaaaccatgatctctctccccacaaaaatccacattttggtgccctgctcctccagattcttatatttagggtgaaatcaaacaaatctctgtttatattggacagtaatgggagttagtaaagcattttcacctttacaattccccatataatcttcatgttatgggaacacattttctgaactccaaagagagagagagacttatgacagcgattttaagctccaaggaagtgtgtgtgtgtttgtgtgtgtgtgtgtgtgtgtgtgtgtctgcgtgtctgtgtgtccatcccatggtggtggcatattgatagggattctgatagcccctcttattgccccaattatatgggtggggggcattagagaaggatagctttcaattattctaatagcccctggcccaggactgcatctttggagacatagcctggagcttttggcttcttcagagttgaagtttgtcttccattgcacaggcaggaacactgagctggagtgaaccagatggtctttatgaaccaaagtggaacttacacaacaggatttagatgggtagtctagcgatgtgtttatgcatttgtgcgtatgtgtgtgtgctggtgttgagaagcaggggcagaacctctgaggaagagaggcctcacatgaacagctgtgaggaggtggaagtgaagccagtatattcagaggagaatgaggaggtgtcagattggccccacagcagcaggaaagctgagcatctgagaccagatgctgggagataccaaagtttgcctgaacaccttgtatggatttaagtttaatgaaaccaaggggcttcaggtggtctatgccctgcctgagtaagactgacgtatttaggctccctttccccctccaaaggatactttctggctacataatactttaggcaatgctttctgtgcccacccaggatgaggtgctgacccaggcccagctggggggaagctttatggatgttccaactgcttttcatccacgcaccaggctcatttgtgccagatgaaagggcacaataataacagtggcaatttaaatcgtgcttctcactttccccctgaaaagtggcgaagtgactcaccactgttgaattgtccctctctatccaccccctgacctctttgcagcagtctaggctggttccctgggggctaagctgggagctagagcttccagaggccctttagctgtgactgggatgacatcatgcccccccataaatgtgttccccaaaatgcgatgtattgctttaatttgggtttctcagatgaggctgcttggaaggcattagagcagcatgagccccattaggcaagtgcagtgccccccgactcatgaataatataaaatggggtccattcagtaatcttttctgagggagaggctctgcttgtttttctacatgcagtttggtatgcagatgcttgctctatttgaaattcgccatataccaacttctggtagtgatattgtaaaaatgggtctgggggagctgtgaaatcattctgttactccaccctgattcttcacctccatttccctccatacccaaatcccctgaccctgtggctagaaaatgttcattttcaactctttctttcagcaccagcctacggagagctcccagaactggagctagtgaggtgcacttgtgcctagagtaattacagattttgaagtatcaacaaagcaggtaattaggtggagaaagtatccgctgtctgggagacaaagacagtaattatgatgagtactcttggtgctgtcagtaaactcaaaagaaagatttgtagagaaatgataatgtttgatagaaacttcaatgtctagcaggaatcaggggactcttagtaaagccacctggtatgtaatacaggtttaggaaatatggtagacctgagttcaaataccagctcagcctcctagggtctgtgtgatcttggggaaattacttaactactctgagcctgatgtatgaagtgtaaaaatagcaataattatagctctgtctaccttacaggatcattgtaaggacccaaggagataatgcatgtcagaacacttagcacaatgcccagtacacagtaggtacttaacaaatggcaacattattattattattacaactatccttgctacataccaggtattctctacagccgttcagagtttaaaaagggaaagaaatgattgcagttatgtatgatcatggcatgagaagtatgaagggtgtaattgtggtggctcaaagaagcgagccctcagttgagagggaaaagtacagaagagcagagaaagttttgtgattctggagttaggtttaaaaaaaataagtaggagtttgtcacaaggcccaaggggaaagggcttccaggcaactggatctgcccacacaaagccaaaaaggtgtgaaacagccaggccctgagcaaatagttgggctcagctaggcaccagctgggatctcctgggcgggggaggggtgtcaggtcagagaccaagaatctttccagcttactcccaccagcccctgtatcgcgccctaggcgccctacctggccaatcacgtgcggtgccctcctcttctttcctttaagcagccaggtacattcacaccctgccccagcgggccttgccgacacagaggtgggcgggcaggcgaacccccacggtgaagatcagaccagcgggaacccctgccggggtcgcggcccctacttcctttcttctctcagtcccagcccaacgtcccactcgtccccgcccccaaccacacacacggtcacttgggttcttttagacaaccctgtactctcacacaccgcacccatacacttacgcggcaatcccccttcaagacacacacaaccccttcatccaagcacgtaagctgaccacatgcgtccacaccacacacatgagaacatcacaccaaaagacacacaccgcaccctcacatgcataaacctttgaacacacatctcaagtagattgacttatagagaaatcttgcacacgcacacattcacacactacacagttcaacagacaccacctgtaaacccacattgacacactgcatctaagcataaacacactccacacatatgcacacaagcttcaacgggcacacacacatccacacattgcacacacatatacactcaccacagcacgaccacaaaccccggcaggaacagcacacacccaccttcaaaccgcacccacataatcccactataatcgggcagaaacatacaacctataagcgtgcacacacaaacacatgctgcatgtcaaagcgcaaaccaaatacacaccacaccaagcactccagctaaaacgtgctccgcgcacacaccccccacacccggccacacaccgaacgcacacacagatctaccgcacccgcgcgcgcgcacacacgcttacatgcatacatacatacatacacagcccgcccccgccttccctttgggcggaagagaagggggcgaggaggagaggaggggaaaaaaggaggggggatgagcgagccaggcggggcgggcacagatgctcttttccttttgacctggggtgttgcccccatgttccccattcccaagcaaagggagtaagtgagttggatccaaggaaaatccaggcggaacccaggaaaacaagaaggtctagggaatcagcgagctggcgcgaggtctccgcggggaccctgactcagcgcactgtcgaccccgccggaggctcctcctcccagtaccctccccctggccctttcactgccttgacctctgtccccctccgcacccccaccctcagccaggacatgtgcttctctccccggcccccacccgcccccaccccccgagccccactggagagaactggccactgttaagggttgagggctttattggtttcaagaagtaaggagttaagactggcagacaagctttttgcgaagcctgttctaatctagcttgaagacttttcttaatggagagctcactctttctcaaagcatcacattttctacgtaaagggcaatggctattagaaatccccgaccccgcgctggacacatagtagggctctctaaatgttcccccctcccgcttatgtcaccacatttggcaaggctgtctgcagcctagcactggctcgcaacagctgttgggcagtcagtcggtgagctcttttcttagcccactagccctcctgaaaacagcagcttcggactgggcgccacaggcggcagggggcgatagagtcgctaacggtgctttgcacttctggttctggccgcacagcccctgtgagaatctctgaggtgccctcccgccataagcggactatgcgagtggtggcggcgggggtcactccggaatgatccgcggccagatgactttctggctcctgtcctccacttgcttcttttctgtggagatggacagcaagggaaagggagatggacctccccctccgactaccccgtggcgcattatgtaaagtgtcatgtaaaaatacccaggcttcagagttctttataggttcgaatcccagctctgccacttcttagctgactaacgtggtaagtcgctggcttaggtcgcggggtagttgtgaggcttagaggaagtaacatatgtgaagtacttcttccagttaacatacagaggatgtccattccctccctctttcccccaccctcttcaaaaatataaagatatgggagtttaaaagaaaggggattagagtctggcaggggggacatggccaccagctgatgctcccaagccaggccagaaacacagaggacgggcaggagttcagttaacttgcaatatgctgtatttaagggaaatgcctgcaccaatgatttggtgatgccattcactggccacaagagaatccaggtcacaactccaatccttggatttgtgatgaggctgttctgcccatcacctcccctccttacaaggacttcctaactcacctccacttgtattcttttccttcttacagagatgccacagtaatatttttaaacttcttgtgagcactccttgggtgccaggaatgtctcctgttaacttatgtcccagcagcatctagcgctgtgccagacacacagtgcaagcgctatacaggcggcaagagatgtcctgggtgaaatccctaggaaacattgagactcgagggtacatgaggagttatcataaggaacctaaagagaggaccctaggcactgcagggatggagggcagtggctttggataaagagttattccattggacaaagagttattccattggacaaagagttattccattcctcctcaaagccctccacctctaagcctgtctggaagagcattgcttcactgcggctgaggcttctgcaggcaactaagaagaaagcctctttcctggagggcagaggccctggccagctagagggtgattcaccatctcagttaggtagcagagatggcgctaaagtggcaatgaatcagtccaagatggcatgaggagattacctgagtgatgatgagaagggggatgaggcaggagcctgagcccttgaggctgggactgagtgatagaacgtctatattcatatgcacaaagtcagctcctaacctgcctccccagttccacaaccaagtccccaaggatagcattggcacactcctggggaggggaatgtttgggagacttgggttccaatcctgactctgctacttactatgtgactttgggcaagttattttcccctctctgggcttcagtggcaaggtaagtgctaggtacttcacctatgtcatttcacacattcctctccacggtattattggagcactaattttcctattttgcagttgagaaaactgaggctgagtgatattttgttatctaccttctctctatatcatgcggtctttgtgtatgtatgttaccaggcaatcgctgtaatccaggcctcttctagtatgccagtcctctatttaaattggatccctatgtactcaggttcaaatcgtgtctcccagctgcccccaataccagcccatgttgctagttacctgggtgggttttcttttcctctccggcgacaccctctcccacctcaactcaagtttttttcctggcatataggtctaaaatctcacattaaaaagcaagcgtcaccagaaagacgtactccaatgttttgtgttttatcacagtggagggtgctggttgcagggtgctggttgcaggatgctgcagtgaggaaggggagcagagcttccagggccagagggaggggctgcagaaaaatccagggagagagagaagacagagagagagagagagagacagagacagagacagagagagacagagaaagaggggatgccagggacaaattggaccagcctcaaactgctgctccctccctttctccccctctacttacctggtgctctagaatgtataaaggggcagcacccagtccacttacagcaggaggagagggagaggtcctctcctctcctctccttcaatggaagggcaaattgtcctgagtattcaaattgtactcctgtgttgggtaagatttatttaattctggggggaggggagggcgagggcctcatcatggtagcaatgatggtgaggtggcacttaaattgaaaagagcaccaccagtgctgcttagagccagacgctctctctctttactagaggataagtgaaacttgacactgggcttctggatcttatttccaatccaggcacctaagagtcatatctctgagcctttggagaataagtccatgtctgcctgggcttccacagcagctatacttggagccagcagctgtactctatcctttcccttcctttttcttccttctctcctttgcccaggctctgcttccccatgtttccctcttgctgggctcacccatagtctcttatattcttgactcttctctttcttctccatttctgtccctctttgttgacaacactgtcccttgtgcatttacttggcccaagacaggagagaattcaattggggggggtgtaattgtgtatttgaaattctcccacttaagatcttgtgattataaccccatattgcccttgttgcatcagataagaatattaagctcttgtaaattatatatttttgcttggttgaatggtgatttgtatatatgattggtgggctgcagtttagaagagagtatttttggaagaggtattaaaaggtaagatggtttgggctggtgtagatggcctcctgacttctctaagtgcctagatatgcaaagaagacagtacatgaaaaattaagactatagtagtggggggcaggggtgggagaccattgccagccaggtcgatggaggactttgtgaagtcagcttctgttttgctcttgctgatcattgaactttgaaaaaaatgacctttttatctctgagtttggaagaccagaggccctagacaagaagaccagaggccctagacaggaaggggaaacaaaaagcagaaagagtgaggcaaggaggggaaaggactattccttgtgcagtccttgtgtgcaaagggccaacaaagaatgtcccctgccctcaaatgccacaccagtcaaggcagaagggaagcaaagtgctgtggcaaattgtgtgctgagctgggatccaggagttctggaccttcatcttggctctgccactaattagctgtgtccttgggtaagtttcttaaccatctgaacctccatttctgctcttccttcacttgtactgtgagattgtgtggcatggccaggggaggggaggttcagagcattcagagggaagggacccttgggctgaatcttgaaggagagctctgctttgaataggggagagaagattgtggggtacagtgagaaccagtgggagtggcccagagaattcagcaaacaggtatacgtaaggcactgagctggctgctgggtagaaaattgctatgaatcagccccctcctcaccgcggcaagctttccagagagtaggggaatctgagaggcagagccaagcgctggcagtgcctgcagctcctctcagcactacccgctgccgcccgccggactgtcgagcaggtcacgcagcctttccctggccggaccaagaggctcgccaagaggtagtgcaggggtagggcaccagtggcctgagcgcagcccactgcggggtgagagagggaggtgagggcacttccacgtggaaggcccgacgtgagggagggagaggagacctgagagtgtggaacaagttgcccaggcttttgcgttcgatgtctcaaacgtaagagcgcaagaaagatttaatttttctaattctcagaggagcaggaagcagtgagtggtttccgcgcgccgcagggctttgtttaactttacaggttctgcgctgcctggagctacccaggggcaggacccgcgcagcgcacctcaacccagcctaaaggccatgctctgcagcgcagtggcagccagagacccagggcaaccccgagaggcagagggcgcacattccgcagccccctaccctcacctctgtccctagctcagagccgagggcacgcagcgggacgggtgctcgggcggagggtcggaggtggagacaggctcagtcccctgcactctggccccttggaggggcttgggggtggtgggctctctcttcaactgcgaatagcagccgtgtggccctgtgtcccggagttagctaagtccagtggaagaatcaaggactttgcagacgtgagagttgtgtctctacagtgcccttagataaacagaatgataataaattatgccagtatgtttcgggcttggagacgctctctgacttgcccaaggccacccagctgcttagtaactgaggaggcctcctgactcctggtctagggatttttctgattgcgtcatagccatgagagtggtccaattttgaatggggatggatagatggatggatggatggatagacagacagacagatattgatatttttaaaaatatgcttatttgaatgtagttttaaaataccattcctgccatgaaaactacagggaaaaacatctcccacagccccagttccctatgacagccactcagacaggattttgaaaaagaaaactgacagaaaattggatgcttgttggggaagatatgatcaaaggagaatagagggggtaggagtgggggaacaaagatggaggagaagaagctctcagcacggattctgagaacttccttattctgaaggtttctttgatatggcctctgttcagatggcttccgggagtgtccccatcagtcctttatttcttatgcccactctgtagaagccacagatgtggtctggagaggcagatattgatgacccttcttttaattaagtctcatttccctttttccctctcttgtagtgagtacatcgaagaagggaattttgtatgtgtgtgagtgtgtgtgtgtgtgtgtgtgagagagagagagagagggaaaatgcttatgtaagagagtgtaagggtgtgtgtgtacatggatgtctgtgagtgggaatatgtgtgtgtgtgtgtgtctgaaagggagcaggtctcaaagagggaagctttgagagaggcaagggagataagaagaatgaatccgaatttacagagtgcaaactaaaaacttatagctgactagggatctgtccagtgctggtgggcctggggaaatagtcaattcttaatattccttaaaagaacaaaggaaaggaaacatatttaaattagtgcaagaaagatgatgttaaacccatgggcctttcttgatagtcttcagacacttgacatttatgtgaccttcgactaggctgtgagatcccagggcaggaacaagggctttctactccaggtagctctccccttccctccaccatctctagcatgggtggcttccatactgtgccaaggaagccaaagttcaggattaaatccattttgtaggccagttagcttttatctacatttcatagactagactaatccccacatatcacacagttagctgccttgcatctctgatcatgaaagacccagtgaaaatacagttcatcttatcccatctagaagtgtgcttcctgctgacagtgggtgagtacccattttcatcttcaaaggatgatacagaggcattcttcagcaggggacactatctgcctcattccagatagtagcacttctgctaagtcttcctctcaagtttggctcccaggtattttggagggcaattcctcaccttgcttgtttgcttgcttggcatagaaatgtaccctttggagaacactttcattctacccttttattttatcttcacagccacacttaataggtaccatgattcttgttttgtaaggtcatggatctgaggctcagaaaagcaagataatttgctctctgtcacatagttagtgagtgtgtaaacttacatggagtgaagctgggatttgaagctaagttccagtctatatcacaggaccttgccaggataccatgctgtcaggttgggggtgggctggggtaagaaatatggtgagatgcctacacagggcttttggtgtctttctcctctgtcaactcctctcctctacctttcataatagtcttttttttccaaaaacatatatatactcttcctgtaaatatatatatacacacacacatatataaacacacacacacgcatatatatgtgtgtatatatatgtgtgtgtgtgtgtgtgtgtgtgtgtgtccatgtatctatctttctttctatcttcatttcccacggaatggcacagagcaatgtataaaaataatacctcaaaaatccaaccacatccttaggaaagaaggtagtcttggtttagactttcccagttccaggcagcagatgttggtggtgaataccaagaactgctatggtttggtggaaagggcaaggcttgagttggggataggaagggagagctggttcccagatcatattcctccatggcatttttgtgcaactttagataagtcacagcctctccaaagtcttagtttgttgctattgtaaaatggggaggaaatatccaacctacctctttcccaggggttattgtaagaataaagtggcatgattcatttattcatgaatcacgaatagctgttttaattacaagactctcaagagcttataatcctgtgattcactcgacaaacacttattgaacatctattgtgtgctagggtctggagataatgggcatatggaaagcttttaagaaaatgaaaagcaggagacaaattaggcattaaaaacttttacctcctattgatagaacattttatttttaacttcttccaccacaatttaatagaagcagcaaccaaaaggggaaaaaatgatatgcatgacacagcttgtgatgccaacactattatgcaccctgatacatattgcagataatagtgagaatatctgtatcttcgtgtacttgatgtcacattgccttgtttacactatcctttgggatgtttatagcataaaaattgcctttcaccatcctgagcctgagttgtttctttagtcaataaaatttaaaaacaggattccatggaatgacgactgtacttattttacaaagatgctgtaatatgtggtggctgcctgccgtcagatatgacctaccctggcttatggaatcaggctttgattatgtgtattcttttgatttctttatttagcaatgcagaatcttgcagctagtgaaagcaagtatgggtgcgtcaatggcaagagccctgagactgaagagaactgggttcttgtccaagctctgttgtcaaattgctgtgtggtcttgggaaaacccctgtctctctgtgagcctcagttttctgacctgtataatggaggtttgggaccaggtgatggctaaggtcctatttctgaaacattctaatattataatgtttctgaaactttcttatttttttgaagccagggcttttctccatatattttaacagtaatattacctctagtttatgaccttctgctataacatgatgggctgactcaatgtattgatgaacactatccccagatttaattatcttggagcgtcatcaccacattgtataaaatgagccatattgttcattgcatcagcagcctttgctgaaatggaggttatgggataacaactttaaggctaactcattaatgctctgggatgaataagctaatgtgtcagcagaccaaactggtgcccaaatgttttcgtatagagacccatatctctttcccatgttgtgatacattaatggggatgtctttatccattgccgctgcctgtagtcatttgaataatgtagatgcagtaccttctgggcacccagccccattcactatcaatttcctaaactttgaggcactctcagaggcttggaccaaaattctagtgatgccatagagtacctaatttataaggatttaaaccatggcatcagtgcagtccctgcttttttttttccataggtgtttactagtaagcactgcaccattcttaactattttatgggggtaatggagtaaattagtcctccaaatcatgaaggctgtagatttatgcctagttgaaaccatttcagtcctcacaatgttgaagtgggtaacctttctgacgttaatttgtttctccatctgtgtgccatgcattttgggaggacgtgagaaacaggcttgatgccattcaagtgtgtttcccctttttgtattgatggaaacttgatttgtgcctgtccgctctttgttcaaattctctctcttgatatctgctcatattctagcccctttacttatccaaataaaatcatatatatatatatatatatatatatatatatatatatatattgctagtgacaatgtagaattggatggcttgaaagagaaacaaattttgagacatacaggcactttattaatctgaataataacatttgaaatattaacctatgcagttagtttttctaaattttataaaatgttttttttaaatacttgactctgctgaaattggagaatgaagaagaaagatatatcccttaaaatctcctaagatctctttacataattcaaatttagtggagaagagtagattgttcaatggattgatacaaattctaattttatgtaattacttttgaaacatgattttttttgtaaactccagccctctgcaaagaaccttcactattaacatgtttattaaaaaccaatgctaaataccacacataatattattcattcaactctcagacaaccactgaaatggatactgtgtcatttcaccattttatagagaaggccactgagactcagagaattcaactgactttcttaagatcacacagctaagaaatctagaggctggctttgaactcagttatatttggctctaacactagtaaaagtatttgtctaaagatagtgtttctgcaaatgttttgaattctagactgaaactgagctggtttgctttcatcttgcttttgaatctcatggtctcttcaggctagtgccatggtatactgaaggggtaaggggaaaacactttggagcaagagaggtctcttggcacctctttcctgtagggagcctccttttgtgttcagcttgaaatgtcaggcctgaagtattcaaatctcaagatcctgttatgtgcctctctcatagtgcgaaagcctgcctactcattccccctccccaccccacccatctgcttcttgtctggggacattggtcttcctaaatctgcttctgtattgtatgctactggcaccttgagaaggttgaaagcaagtaaggcaatgccaatttttctgttagaactgcagcatataactgctcttaagtttagccctgtgtgctggagcagggaggcaatgacaaacggtttattctaaggcctttgatttccttcggaattgtaagcatctaggctgactcatctctcaaaggcttttctctctctctccttttggggctgttgttgattggggattttactgtttgttcttaccttatatttgggggagagaagggactgattttcatcttatttttgggtgaaaaaaccagctctgctctttggatgatcagatctggtaagcttcgataagaagaaatagctgaaactccaaaacaggtacaaaagatatctggattggggaaaggggagaggggagtaatgttagagaaattaagccagagctaggctgtgtgtctcaggatgagaccctagactaataggctctggacctgctattttgaatggggaattgctagaggcttagtctggaactgtggttaaatgcatgtgcctttggttaaaatggtcactttgcaagttgcagtttggtggttggggttaggtgttcactttgggtccaggggatggagctttgcagttgaaggtttaatatctatgctaggtgttttcctcttggtttagttcaaaagccacaggaaaactcctcatcttttctcttactgcacctatttctgacatctgtgatcctggctactaagggaagtaggcaaaagagttttggagacaaaattcaagtatggtttatttgtttgtttgttttttgttttttgttttttgtttttttttttttggacagaaggtagctcatctatttagattattgcatgataaaccgttacttaacttttctctgccaaagctgcattgcctgatctttgaaatttaagctccccaccccccaaatcatatatagaatgttattgtagattccatgggaaagagacattcagtaaagttgtatgtaactacttcctttcttggcaaaaggtttagttccccatctcctgaattatcttctctatcaggaaccagccatatttacccaaaccatgaacttgggagctatcctaaattgttttctttccattgcaattaaagatgttccctaagccctgtcagttccatccatgagattcgtcccctactccagccctagtgacactgacttgtgtcaatatcccttgcctcttggctcatctacctacttccagctctctacccaaaacaggctttttcatggctttctgtgatttttccaaggtgcaaccctgaatctttcactccctgcctaaagccctattgccttcaggaaaaagtccgactctttaagctggcttatagggccatccatgatctcatccctgcccatccagatttttctccttccaatccctttatacagcttcaagaatatgacaacctctctcccatctcttttcctttgcacaagctgttctctctggatgctcccctcctctgtctccaggcagatttagctgttttctcctttctgctctcacaatactttgtttatatcttggaggtctaacatcacaaggttttgtaaattgttgctaacttgtgtatctccttcactgcactgttaaatctttaaaaaaaaaaaaaaagaaatagtattaccttgctcatcctttcaatctttagcgcctggcacaaagtgggcaattaatacaggtttttgttttaatgaatgaatgaatgagtgaacaaatgagtaatagagaatgtgcgggaaaggatgctgtgtgaggtgtaggggcataccccattggggatgctttgtagtctggaagtagtataagatagtgggcatcatggagaaggcacatataaaataggttttaccattacactaagacaaactccactttgataccaattctgtttaaggagtctcactagaaatggtctggaaatgatgtttgttggttttggtacaaatgatttttttatgaaaaagtaatataatgaagttgtacaatgtttggtaaatagagaaaagcaacaggcaaacaaaatctcaccagttaatgcaaatgctgttagcatttgggtgcatttccttcagtcttttatttttatgcatgtttttcttcacatagttgcaatcaaaattaatacaattctgtgttttgtatttgttgttaaaaaactctttgtaaatataactttaatgattgcataatttttccatactgtggccattacaaaatttatataactaatatcattgctgggctagctttttttccctttttttgttactattatggtttatgtggatatgcttttccctgtctgtaggaagattttattaggatagattcctagaaggggagttactaggtcaaagggcctggggacgatttttggctctagacccatgtgtccattttgttttctggacttgtctgaatttgcagctctcctaacctagatgaaagtcccctttttatccaacctggacagcatcgagtatcgtcatggaaagaaaaaaaaaaacctctaaaaacgctctaattaattaactaattaattaatggaaaatactatcttatttttgtttcaaagtgcttttgttaaaaaatgtttttctcttttattttttcttcttattttctctctttgtactttttttttctaattaggttttctttttcctggactatctgttaagggctgaatttttgaagttggattttttttttcttttttagcaaaaacaaccagaggctgctctgcttgagggtgaagccgcctcccagttttccctccccctctacccccacccccatagttctctccaccaggtccagtgacaattggatgatgcagccttgataatcatccgattccagaatgggtggctgcattccttttctgaaggcagcaagggcactgtgccccagaatcatgccccctttgctgttgttgtccgccttcatttttttagtgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagaggtaagctgtaccccggattgtggcatcctcgccttcgggagagtggaccctccgggcaggacggggcggattaggggtctggcagggtgggaggggctcacgcctgatctcggacttgatcagttctcctggcgtctggggaactgaagaagccggagttgaaggctgtttgttgaattgcggaagaggtaaaaattagttgagtttggtcgaaggctgggagttgagggggcagtaagacagacgggcagatgtcagggacagacaagtggacagagggccggtgaagagacagccgcagcaggtgcggtgcgagaatagggcagagcgagacggaagcgcagagggacactctggagagaactgggagagatagagacagcgcggtcgagagacagagagtagagggagatagcaagacagtgcgtgagagagagacgctcctagccgggcggtgaacgggagggcggtgcgggcgcgggggcggcggcaggaggtgcgcctctagcactgcccacctcagctggctgccggggagcgagcaggacgcggcgcaggacgaggttcgagtgcaccagggaatctcaggggtaagcgcgcggatttggcagcggagcccaggcggttagcgcggacccaggcgcgccccagaggtattggaaagtgctgggggtggcagcttcgctaggcgcgcaccgcgaacgcagcttgaattgagcgaagcaaagggcgaggagcccccgctggcagccactgatgccagattcggagtgcggggacagccaggtgtcgccgcttctcctaccgcagcgcagggagccgacggcaacctggtgcgagcgcgcccgcagtaacttggcgaccctcacccgcggtggcgctgcaggagagcccctccctcccctctcctgttgcgtgatctgggggcttcagagccccggaatttatgttttaagtgttgtattgagcgactacgggtgcgtagcaagatgcgcggtgcgcacgcggcgcattagattgtctggtttggttaaattcttggagtctgataagagtgagataggcttgtccttgttgttaggtggggaaactgaggctcatagaaagcaaattacttttcgcccgctgggcagagctcgcctctctgccgctccctccccctgctgcagatcagggcattgggatgttttagtcacttattaagtcctatttgtaagtgtatcttttcttttttctctttctgtagctctgcctattgaccgtccgaacaccttggataagtggtttctgattttgagaggacagcagaggggtgagggggctcttgtattttctttagaaaagaaatagaatgctaaccccctgtgtagtgtggccctggctattggagactgggtggcgtccactgtcccaggggacactctcctcagctcccaaaccccacagtgggtgatatcaggaaatggcgcagtagctgtaggtgcttggggcggtcctctcagaccttcctggtggactcaccccacacagatcaacccgaagaaatcgccctctttgtttcaaggtagtcacccccagggaaaatttaaggcagggacctcgagcctcgtcggggtggttgagtggagctgagtcctttcgccaaaccactgcggggtctttttggctagctccccagggaggggcgctgcggttctggagaggtggggttggctgcgggtggttgctgggaggagtgctacagcccctgcttcctcctgatttaagcgctgcgaggctttgacgtttctcattctttctctcgtggctccccagctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgagtgagttaaaccctccaggtttcaggcaggggcctctcctgaggtatgcaggaatgtgaggccggaggatcaaggcctgtgccctcagaggcaggggggagctgaacacaatatgttgaagtggtgtccttggcttgccacaaagggaatgtatcttgtcctgaatgtcatacatacagtactcaggaaggtcctaattgactctctttatttcccattttaagataatctggatttctccacagggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggtaagggagctgcaaatgggtaaatcaaggaaggaagcaaagggaaaggagggatgttctggaaatggggggagaaaagaggccgaggatgaagggcttggataacattcccctgacacccagtggaggtcgcgatgcagtagggggtgaggggagaagagaaatgccatgggaaagggattcagagatgcttagcatcccctggtcttttctttcaggcttaagcgcagtggggatttttacccttgaatactccgtgcagcgagtgcgtcaggtaaattggctatgtttacatgtttgttcctccaataagaaagagcaggaggaggtggggtttccccatagacctgactacctggtggggggaggagcagggtcttctttgtagcccccaggcccaccatattgccagctacctccactgaatactggaacctgttgaaggaatgaccaagatggagctgtggtgggccaggcagacagtccctgtcttctccttttcctagctccgtgaagaatttgatcaaggtctggatgtagtgctggatgacaatcagaatgtgcatgatgtggctgcactcctcaaggagtttttccgtgacatgaaggattctctgctgccagatgatctgtacatgtcattcctcctgacagcaagtgagtcttctgacctccctagtagggcaaggaaaggaaatattactggggtctagggggttctagggacagagctcaggctggaggactttgaagaactaaggcaaaatgaccataagaagattttaaaaacctctccagaatatatacaattattatttgtcaattaaaaataaaattttaataaaaaacttatttgggttactttctttgtatttctaaatgttccattataagtctgttgcttggaaatttctctagagcttcttgaagatgtgtgtgccctctcaggtcaaaaaaaaaaaaaaccacccaggttctgtagaggaggtctggtttttatgggggcacttcttgctttcagagttcctgagctcaaatgctttggaaatgagcaaaggcaagatgcctgggtactttctccataactgccagcaagtttcaagcagaatctcacctcccttggtatcagtctgcagccaagactatccccctgagacagcccctgttttccttcttctagctttaaagccccaggatcagctttctgccctgcagttgctggtctacctgatgccaccctgccacagtgataccctggagcgtctgctgaaggccctgcataaaatcactgagaactgcgaggactcaattggcattgatggacagttggtaaaaagatcttggaaagagtagtgaaaactgtagtaggggacatatgtgggagtatatcagcaagagggtggatggagaggagagagagaaacaagaataaaaagagacatattcatttgtacaactcccagtactacctcagcgtcaatcactttctgctttcctttgcctaggtcccaggcaaccgtatgacttccactaacttggccttggtgtttggatctgctctcctgaaaaaaggaaagtttggcaagagagagtccaggaaaacaaagctggggattgatcactatgttgcttctgtcaatgtggtccgtgccatgattgataactgggatgtcctcttccaggtaggtgcaagttttggatgcacttgttttacacatccatctcctgttcacaaggcaaggcacagttgtacctgcatctttgagggtagccaaaacaggcagccacaagatcgtccagtctagaaattcctcccacattagctggccctggtacctttagtcctaggtacctgaaagagatgagtataaatgaaaaggtgctgtgtaatgatggctaatgttgctaattctaccctcaggtgcctccccatattcagaggcaggttgctaagcgcgtgtggaagtccagcccggaagcacttgattttatcagacgcaggaacttgaggaagatccagtgagtgttttttgggtttgtttatgcttagcctgaagtacctcctcctatggggttttccaactccagactatctttatattaagtaacgcaagtacacaaactgactttttcaaaatccttcccattcaggagtgcacgcataaagatggaagaggatgcactactttctgatccagtggaaacctctgctgaagcccgggctgctgtccttgctcaaagcaagccttctgatgaaggtcagttccctgctggaggtcaggcccttgctgaaggtcagtcccttgttgaaggtcaggccctttttgaaggccaggtcgttgctgaagatgagccccttgaggaagatgagtcctctgaggaagatgaagagctagtatttgaatatcttaatcaaggagtagtctttggggaagctcaaggtctagaaatcccaaataactttgagattcagggcccacatcttgaaggaataccagagcttgatgaggaagatgatgatgatgataatgatactttaaattttgatgatcttcctccccttggagatattctagaaccagataatgaaattccagaactcattgagatcccagactttgaagaaattccatattttgatatggtcccagaccttgaaggagccccagatgtgcaagaaatcctgaaccctggagaaaactcaaaccatgacctagaagaaggagcagattttgaagaccaccaaaatcttaaccttgcagaagctccctatcttgatgtaatcccaaacaatgaaatcccagaccacgcagatgcttcagataatgatgaaatccaagattctgaagaagatcccagtcttgaagatgtcccagctgttgatgaagttccaaatgatgaagcctcaaatactgaagaaatcccagactatgaagccccagaggtaaatgggatttcagactctgaggaagaccttgattttgaagaagtctcagctctttatgtggttccaagccctgaagaagcccctggtggacatgaaatcccaaatcatgaagaatctccagaggttagtggactctcagaccctgaagaagatcccagtcttgaagaggtctcagattttgatggaatcccaaaatgatgaggaagcctcagacactgaagaaattccagaccatgaagaagctccagagaccaatggaattgcaggccctgaagaggtcccagctctccatgtagtcacaggccctgaaaatgtctctgattttgatgaaatgcaagaccatgaagaatcctcagatgtgagtggagtcccaaacaccgaagaagcctcagatattgaagaaattccgggacgtgaagaagcctctgatgttagtggaaaccaagactctgaagaaagccctagtcttgaagaagattcagttctctatgtggctccaaaacctaaggatgcccagatttacaacaaagttcaagattatcagaaagaccaagccagtgcatttgaagaagaagaagttaccactatggctccagaaactgatgatgtctccattctcaatacaattccagaccctccacaagacctggctgtcaatcttgaagaagtcatggatgtggaagaagtcccaatgcctaaagatttaaactctaaagaggttcagaatccaaaggcaattcagtttcataaagatgcagatgttgcattccctgtagataccactctccttaaaaacaagtctcagcctggccaagtcatggactacaagtcctcaccagaggtgttgaagggcaacacctgctttctgtcttccatgcagtgctgtaagctttcagctctagctttgttactcatttgcttggtaaaattagtcaggttacttgtagggtggtggtggttattaggaggtcgccctcttacctgtctccctggtggtattgtccattccctctgagcgcagggtatctgtcttactctttctctttcctaactcagctcttttcccagttcccacagtggtcctagattcagagatctgtgttctgctgtcaggctgtagtattcttatatgtcaaatggggataatcatccctgtcctaccttcttgcctcatactgtatttgaaactcaaaattaggtcttagtgccttgggtgctgcgcaaagtataaagtctagaaacataaggagttaacattgttactatttttcaggttcctctgaggagccagctgtgccttccggcactgcccgttcccatgacgatgaggaaggagcgggtaaccctcccattccggagcaagaccgcccattgctccgtgtgccccgggagaaggaggccaaaactggcgtcagctacttctttccttagatgtttttccttctataaggtgccagacaggggaaaagggtgggggtacatctgggatgtcacaggaaacattaaggagagagttgaaggtaaagatctgaaggtaagaaggagttccacctgatgctcgggtcaggatgagaattccaaacacactgccagccccttcactggggatgcttggtctcttctgctggtaaaagcagagatgtttctgtgtcatgcccaagctccccggtgctaccttgcctttctcttttacccctgatcttggctttctctctctctctgcagactttcctttaattgatgtgacatttgtggtaaacacctttcccagggaacctcacaaatcttgagatgctttcccttccccagatgggattgcatgatttccctgactttcctaccctcctccagagagctcagttggaaaggccctcaagaggcatgctagaacgttaggtcagcctactgacagctgacaaacaattaatgcgaaatcatgtcacaccaacccatagccgtgtccacgcagcaactccaccaccttaggatttccccctccaaattattcagaccaatggcttgccaaatggcctctcccaaaattctgtacagttttgctcaggtcacgccaacagggaaacctcaagtgtaggtctaattagtgtttctgggatccaaagttagaggaaaatttagattttattgcctggatctgctttaaagacaattggtgtttacaccctcttgtcagcaaaacagctagttaggtaaggacatatagttccaagtaggtaaagtcacttgattacaaatgttcttaactatcgtctctgtaattcctttatacaggacagtacaaaattgtgggacatgctctggtaacacacagatatgggttgcatatgatccagaattacagctgatattatggatgacaactgctaaggtccataaaatgaagactgtattgtattgagggatagaaattgatcatttaatgggtaacaactgctgagctcaaagatttgtgattgttaaaacttctctggcatttaatcattaataaacatctgtattgtgacagcagcatattcatggcttactgtgtttttcttctttttaatttggggggtgagttgggaagctctgactagagagctgaaggggtaaaggagaggtgaatagaaataaacaggacagggtgatgtagaataaagaagaagatgacatgggataaagggaagggggtgacaaggaatgagggggtggagtgatgtggaataaaggggagggagtgaagtgggaaaaaggggatagagtgatgtggggtaaaggggagggaatagagttgaataaatgagagggggagacatggaatagagagggaatgacatgggataaagggaaggggggtgacatgaaatgagggggtggagtgaggtggaataaaggggaggggatgatatggaataaaggggaggggctgatgtggaataaatggggggtgaggtggaataaagggaagtaaaatagaataaaggggaagggctataatggaataaagggggtggaagtattactattaaagtagaaaaggttaaggggagatgaaagagaagtagaggaagcaaaggaagcttaagaggagagcctataagggggaagggaggggaataaatgaggagaccactaggtattttcaactgagaagttcccccgaatcagtgaaaaataaaatcctaaaaacataggcagacatatgacttccaagggtcagaggaagaacatactgctgtctgactgataaaacttccaacctttcttgaaaacttatggcttcatgacatacttgaaaattttccatgttagatacagggccttagaaagtggaatggtttgtgttatttatttttacacactttgctttagggtatttccttgcatagagctttacagactgcagactcgtagcattgtcccctcctacactaataaattttgtaaataataataatcctgatagttaacacatatcaaggtcttccaaagtgtctgacactgttaaaaactttacgttcatcatttaatttaatattcacaataacactttgagatatatgctactgtcatcttcaatttactcttgaagaaaatgaggtacagagaggttaaataacctgcccaaattacacagttggttagtggaaaaccagccagtctctaaagctggcttgtttaaacactagattatactggtccattcatcttgggattttgcctcagacacaaagatgcactgtgatgtctgcagcaatttttttatattggggtttggactttcaacaagcaagtttcaggtttcttccttataggtcctttctctccagaaaggacaggctattagacaataactgatatttcaggcagattctagcagttatagctggggcttacagatatcagaggcagaagaaaatgtaggagctcacccattccaaccttcttgttatgtgaatagtcatactagggctcagacttgggaaaggtcagaaatccgggagtaagattcggacagaccttctgactgcatttccaggactttatggggtcaaaaaagtaaaatatgtcctgtgaaaagtttatgtgtgctttcaccattcagcttcaaaacaaaccagataacaaagaagaaagtagatttgaaaacattgccttcactctctggccttccctgaaaccaggttttctcctaatcttacatttcttcccagtgccaattcctaaccagcctcagggactgggcctgagagtgtttgtagatgtgggcattatccttgctgttctccacactgtaaggacccagctcacaggcttcctgacactccaagtcctgtccttattctgggtgccaccaacaatgtacacatggaagtcttaccccatataccctggcctcacacctctctgacctttaacttcttagtacctcaaccactcccagtcacttggcatcactgggcgtggcttcaactccaatatcccactgaggcccaaatcttctaacgaaggctgggtccatgccatttgctctttggcttccctgagggatccagtacccaagaccttccttttgtcttcactattttccctgtccagacaaaatttggggcatattgatttagtattaactgccttatcatccccttgccctccaaataccacatctgcactatttatctccaattttcggtctttccaaacaaatgttttctctgattccataataaccactgtgggagaaaggagcagcaccccaagaatttccaacctcagctggcccttctggccaccttgcaatcctttcacacaccctaggtcatctctttctccaattttcatcctatctgtactccaagattttcatcactcctctcaaacaacagcccctttcactctaccctcaccacaccccatacaatggctcagactcctacttcataaaggagattgaggttaacttcagctccttgaccctacacctacaatggtctttttggcttcactaactctcacttcatattgcatagcactacttcttattatatagcactccttcagcttagaagttcctattctagtttcttttcccttgctctgtctctcctctgctttccttctccattacccccacccctaaaaccttgcttacactattatctcagttctcttgcctgatttttaaatctctccttgtctactagttcacttacttcaggatattctcatgatcaagtgtctctcatccttagaaacaattccttgatccgtcatcaccctgtaacaattgctatactgctctttttgtcaaactcattgaaagaagagtctgttctattctgtatcttccttctttttttttttttttttgagacagagtctcatttgtgtcacccaggctggagtgcagtggcatgattgtgactcaatgcaacccctgtctcctgggctcatgccatcctcatgcctcaacctcccaagtagcttgggctacaggcgcatgcttccacaccctactaatttttttttgtattttttgtagagatggggttttgccatgttgaccaggctggtcttgaactcctgagctcaagtgactcacctacctcagcctcccaaagtgctgggattacaggcgtgagccaccacgcctggtctctatcttccttctcacctcccatgtattcttcagtccataccaatcaggcttctattcccactactctaataaaatggtggcaaaagtcaccaccaataacctattattacattcagtaaacattggtaatacacttattttcctcagtctcagtgacaccaccacaccatcatctcttgatgttttacttatattttttaaattaaacatttttatttgagataattgtaggttcacatgcagttttaagaaacaatacagcaaggtcctgaatatcctctacccagtttctccagttgtactatcttgtaaatctacagtacaatatgacaactaagacactgacattgatacagtccagatacagcaatgttccatcaccatgagaattcctcctgttgctcttttatagcaaaatagacaaatctacctttcatccccaccaccccctttcctaacccttggtaactaatctgttatccatttctgtaattttgtcgtgtcaagaatgttatataaatggaatcatacatatgtgagcttttgggagtggcttttttttttcactcaacatgattactttgagattcatccaggttgtgtgtagcagtacttcatctctttttattgctgagtagtatttcatggtatagatgtaccatagtttgtttaaccactcacctactgaaggacattttggttgtttctccagtttggggcgattataaataagactaccatgaacattcgtgtacagaatttgagtggacatatgttttcagttttctggatgaatgcccagctgtgcaattactgggtcgtacacaattgcatgtttagttttataagaaacttacaaaccactttccagagtagttatacaactttatattcacaccagcaatgtatctgcatgcttgctagcatttggtcttgtcactatttctttttatcttgcccatcatgatagttgtgtagcgatatctcattgtggtttaaatttgtatttctctgatgcttaatgacattgaacatctttttatgtgtttatttgccatctgtatagtcttcagtgaaatgtctgttcatgtggatatctaattgctctggcaccaattgtggaaaagactatttgttccccattgaattgcttttgtgccactgcttgcatgatttctggtgataagtccactgtaattcttatccttcttcctttataggcaaagtattttcccctctgacttctttcgtgactttctcattacctttggttttctgcagcttgaatatgatatgcttaagtatgacttttggcaatttatatggtgtcacctgaacttccgggatgtgtggcttgatgtctatcgtcgattttagaaattgatgtaccgttattatttcaaatctttcttctgtttctctctcctctttctggtaatctatttacacatgttacatcatgtgaaaatgtctcatagttcttggatgctcttttcttttttcattcttttttttctttttattttagttaagaagtttctattgacctatctttaagattactcattctttccctggccgtgcccaatgtactgatgagcccattaaaagcagctttcatttctgctagtgttttttcatttttggcatttaaaaattcttacttagaatccccatctctctccttacatgattattctgttcttgcatgttgtctactttttttgattaaagcccttaacatattaaccatagttattttaaattcctgtctgataatcccaacatttgtatcagtcttgttctaatgcttgcattgtctattcagactatgatttttcatgccttttggtgtgccttgtaatttttgttgaaagctgaacatattgtatctgatgtcaggaattaaggtaagtaaacctctagtctgaggattcatgttaatctggcaagaattgggctttgtttaatcttttctgtaactattggtgcctcaggcttaaacttttctatgttcttgtttttgtctccccaattaacattgtgctttcctaagtactcctctgagagagagtctgtgtcttgcagctctttcaattgtaactcactattattatactgtagccctgttggtatggtgttaaggtgtggatcgggggatattttataatcttctgattacatctctcttttaatgggtctgtgtctttgggatgtgacttttacaagtgtttctttaatgatagagcttttcccctcctgcctcctgttccattctttgcctgcagtgtttccaatctatttcttcaaaagtctgacccttgtttacgatttttccctcaggtgagacaggaaggctggaagatgcgggagggcagatgaattctcttctctcagctaggataaagtttcagaattatgttggagagttagcatttgttatggagagggctctagatgtatttcagaaaggttactcttctattatctcaccagtgccataaggagacttttcttggatcctgtatcctcattgtaagaacctgatggggttcctagaagggaaagtagattaaaaaatgtgaggatcctcctaagactgtggatcctatgagtttctgactctcatactagtccacactcagccttttagcaatttttcagaactaccgtttaaatgtttttaccatcttatggttccagtagcttctgctttagttaagcagatttcagttgctgtagatttttgaacgtgcctttctctccagatttagggatgataatttgccctgtgacctcagttatctgatgggtcaagaaaagttgtcgatttttagtttgtccagctttttcttgttgtaggacggaagtgacaacttccaacctgtttatacgttggagctggaaccagacatatctaatattgcatttctaatgtcagtttctacatgttcattgttagtatatagaaaagagattgatttttgtgtgctgatcttgtcttatgtgaccttgatgagcttactagttttaagagagtgttttttaataggttacctgaaacttttctatgcagctaatcatgtcaattgaaaataatggcagttttatatctttctttctaatctatatgcattttattcctttttcttatctaaatgcaatgactagactttccaatattatattgaataatagtggtgagagaggacatccttgcatttttcttcatctttgaggaaaaagcgttcaatgtttcaccattaattatgatgttaggtgtaggtcttttgtataatagatgctttttattaagttgagattgtgcgtctctattcctatcttgctaagaggtttttgctttttatcatgaattttggattttgtcaaatattttttctgtatctgttgatatgatcatatgatttttcatttagcctgtagatattatggattacaatggttgatttatgaatatagaaccagcttacgtatctggaataaattctacttggtcatggtatttaagttgtttatttttacattaatgagttcactatgctatttttttctgagaattcttatgcctagattaatgatccataattgatctgtaactttctgtttttgtacttttttatatagttttggtatcaagataatactggcctcataaaatgcattggaaattggtaattcctcctctgttttctggaaaagattgtatagagttggtgctagtccttctttaaacattgggtagaattctccagtgaaaccaactgggactagagatttcttttttgggaactttagaaattatgaaaaattatgaattaaagaattttatttaattatgataaaactattcagattattttattttgggttttcaaatattaggtacatgtcttttaggttgcaaaatctatgagattaaatttgttcttagtattatcttaacatcctttgaatgtttgcagggtctatagtgatagtctgtttcattcctcatgttagtaatatgtgtcttttctctttttttggttgtcaatcttgtagtagatttttcaattttattgctcttttcaaagaaccagctgtttgtttcattaatttttttctattatattcctgttttcaattttatttatactgatatctttattatttcctcctttctgcttgcatctggtttattctcctctctactttctttaggtaggaacttagattattgatttactcttttctaatgtaagcatttaatgctatctattttcattttagcattgctttaacagtataccactagtgtttatatggcgagtgtttattttcattcagtttgatacatttttaatttcttttgagacattctcattgacccaaggttggtttagtttggtttagtttccaagtgttttgacatttttctcttattgatttgcagtgttgtctggatcatctgttatagatagcacttctatttgatcctgaggaaaaatgagcttatatgaccaccttccgttgccaagctggtggtgaggaaatggcaggcctgggtcaccattttctgttggataagaggtcataagatgactggctaccatttcgttttcctagttctgtggtcccaaaccaagacaccttcctcttccacttttcagagtttttctttggttgtcttttgagttgcttccagagtttatagttgtccttagtgtgcaggagtttggaaagaaagatttatgtgtttttcctaagcagaaatctcatgattatttgaaataattgtttagatataattttcatatacattttaccatctagagtgtacaatttaatgcttttagtatactttcagaggcatgcaaccattgccagaatttaaataaaaatattttcatcaccttaaaaagaaaccatgtagcggttagcagtcactctctatcctccccatcacccaaatcctaggcaaccaaagtagtttctatcttaatagatttgcctcttctggatattttttgtaagtggaattatgcaatatgtgatcttttgtgaccagcttctttcatgtagcataatgtttttaagtttcatctatgttatatgtattaataatatgtatcagaactttattcctttttaatgctgaataacaattaattgtatagctataccatgtttaatttgcattcacctagtaaataatgatgtagagcaattttttgtatttttcctctttctttcatcatgtatctgttcaaatcttttgcccatttttaactaagattttggattggatgttgacagttctttgtacaatctggattttttttttattttttagtttgtgacttgactttcattctctcaattgtgccctttagagagcagaacttctaaaattttaatgaagtctagtttatcattttaaaaaattttatgaatcttgcttttggtgtcatttctaaaaaatctttgcctaatccaagatcacaagatgtctctcttaggtcgacattagaggaaggagatgaggcgcctaaggcacaaaatttaaggaggaactcatgctgagggttgtgcaagtccctgagaatgaggatgtccttatattttgcaccctcagttcctcacttgtgtcaccctattcctggtcctgtattcttgttttttgtttcctagaaattttttatcatttaatttattcagtcattagttgaggatcaattaggttgtttccagtttttcctattttaaatattgctgttataaacattcatatacaagttttggtgtggaggtatgttttcatttctcttaagtatgtatctaggagtggaattgctcgtcatatggtaaccgtaagtttaaatattagagaaactgccaaacactttgtaaaaaatgtgactgcatcattttgcattcctaccagaaatgtctgatatttccaatttcttcatatccttgccaataatatttgttatctgacttttttattatagccctcccagtgagtctgaatggcatcttcttgtggttttggtttgcatttccctattgactagtaatgccaatcaatgtaattaatatatcatattaagaaacaaaatgtaaaaaatatatttttagtttgtttatttctgtctatgatttattttgagttgatttttaaattttatttttatttttatattttggagacagggtctcactctgttgcccaagctggagtgcagtggtgtgatcatggctcaccacaggatcgatctcctgcgctcaaaggatcctcccacctcagtatcccaagtagctgggactacaggtgtgccaacacaaccatctaatttttgtattttttgtagagatggggtttagctatgttgcccagcttggtcttgaactcctgagttcaagtaatacactcacctcagcctcccaaagtgtggggatcacagaaatgagccaccgctagccttgagttgattttgtatatagtataaggtatggattgaagtttatctttttcttccatacagatagtcacattttctagcaccatttattgaaaagactaccatttcttcactgaattgcctttatagctttatcaaaaatcagttaataattcattttttctgtatttctacattttgtctgtttgaaggatctatttgtctatttttatgtcagtatcatactatcttcatgactataaataaacctttaaattgagtagtcttagccaccaagtttattctcctttatccaagttgtttagaatattcttggtcctctgcatttaaataggaattttggagtcagtttatcagcttaatgaaagcagtctcataggattttgattggtattgcattgaatctgtagatcaattccgagattcttttgacccactaacaaggtaaatctccacttatttatgtcttttttattatctgtcagcaacatattatagttttcagtaatattgcagctctgctgtcagaattatttgtatttcacatttctgatgcctttgtaaatggtattttaaaaaattttaacttatgattactcattattagtatatagaaataaaagtaaattttggaagttgaatttgtatattatcagtcataatagttttgttttgtaaaattggttggcttttctacattgatgactgtggtatctgtgaataaagtcttccttattcctttggggtctgcaataaagactcacctcttatttttcttgtcttggggcactagctgcaacctttagtgcagcgacacacaacaacacacatttattttctcacagtttctgtgggtaaggaatctaggcatggcttaatgagatattctgctctgggtctcaaaggctgcaatcaaggttttgattgattatattttcatctagagaatcaactagaaaagaatctgcttccaaaatcattaaacttgttggcctaattaatttccttgcaactgtatgactaaaggcctttgtttcttaccttagctggaggtgtccccaaggtcctagaggccaccttcagtttttttttcccatgtgactatctctataggcagttcataacatgttcgtctgcttctttaaagctagcagaaaatctctcttaccagtctggtaagacttttataacgcaatataatgataggagaggcagcttatcatctttgccgtataacaggacctcactaaaggagtaatatcccattactcttgtcgtattctaccagttagaagcaaatcacatgtgccacctaaactcaaggtgagtggattacacaggacataaaaacaggaagtagagatcctgggaaccatattcatattttctctgccacataagaatcctaagatatgccatttcctccctcccaattttttgaaaatgtcacgtattttacttttaatatgctaaaaccccagtggttttccttcttttgtgcatatccatatttatagatacacacctgaagggcttcctgtacaatttgcttaatgcaaaatgtaattagtgattaattctttcagcttttttgtatcctaaaatgttattttatcccttttaaaaaaacacattttggctgggtatggaattgtggatttactttgtccttcttacagtactttaaacatatcgttttactgtcttatagctttcatggtttctgaaaagaaattatctatcatccttacctgtcttcctctacatgatgtgtcttttttctaggctcattttaagagtttgttttcatgaattactgtggttaattttattatgatgtgcttaatgtattttttttcatctttgttgtgcttggacatgctaaagttactggatctgtggttttgtagttttcaccaattctagaaagttttatactattatttcttcaaatatttagttttctgtctctctctcctcctcttcagaggctccaatcacatgtatattaggctactttaaattatcccacaacttaatgatgttcctcattttacttccatctcttttctccctgtatttcattttggagagttttgatttctatatctttatctttgtttatcttttactttgaatgtctgatatattgttattcccattgactgtatttttcacctcagacaatgtggtttacatctctgcaagttagacttggatcttttttgtatcttccatttctccagctaacaggttcattcagtatttcctctatcttcttgaacatgagatacaggcaaattgactattttaatgttcttatgtactaattttctcatctgtgccagttttgtgtctgttctgattagctgagttttctccttattatgagtagtgttttcctgatgcattgttcatcttgtaattttttggttggatgccagatgtgaattttgacttgtaggtgttgtatattttgtattcctataactattcgtgagctttgctctaggatgcagctaaattacttgaaaaaaggctggtacttaatgtcttccttttaaacttccaggtagaccagaacagcacttagtctagggttcattttcttcactactcagacaagacccttctgagtattcctctctatgtcccatgaattatgaggtctttcactctggtggtaggtacataaattattttctgccttatgtgaatatgaggtactatttctataatccctttgggttcttacatgcacaaatccatcagccctgatctaagcaatgaataaggacactctgcagatctcctcatttctttatctgtttgactctctcctctcaattactctgccctgtgaactttagctacctgggattcctaggacttctaggtctaactcctcaactcagagagaatgcctggattctgggcaacacctgggtttctatcctctgcactgcaccttggtacatctttcaggcagcaagctggaacaattgttggctcatctcattcattttctgtctttcagggatcactgtcctttgttgtatgacattcaatgtcttgagaaccattatttcatatacattgattgtttttagtcatgtcaagtgggatggtaaatttgctccctgttactccttcctgttcaaaaggaaaatcagaaatatttattaattttacactgtttagaagatttctggatatctttctgttgtttatttctaatttaattctgtgtggttatagaacatactttgtctgattcaaatccttcaaattagttgaagtttgttttacaagtcagaaatatggtagtatatcttggcaagtgttgcatgtgtacttgaaactgttttgctgttgttgggtgctgtattttctgtatatattaagacaagtggttaatagtataactcaagtaatctgtatactgcacatatttatttctctgtgcttgtagaaagagtactgaaatctccaactataaatgtgaatttgtttattttgttttaagatttgtatttgcttcatctatttttgaagctctgatgttaggtacacacacatttagaattgttgtttcgttagtgaattgaccccttcgtaagtatacaaaggcccttttatccctggtaatattgctagtcttaacattaacattatctgacattaatgtagccattttggctttccttttttcatttttaaaaacagctttattgagatatgattcatataccacaaaatttatccatttgaagtacacaatctaatggtttagaaaattgatagagttgtataaccatcatcactacccaatttttagaacatttacctcccttttaaaagaaaagtcatacaccttagcagtcattccctattccttcttatcctcagccctaggtaacactaatctaagttttatctctataaatttgcctattgtggacatttcctataaagggaatcttaaaatgtgtgaccttttgtgactggattcttttactgaacatattttcaaggttcatccatgttatagtatgtataagtactacattcattgtttattggcattacatattctattttatggatatatcacattttactaatctcttcattagctgattggcatttggactgtttccactttgggctgttatgagcagtgctactatgaacatttttgtgcagatatatgtttgatttctcttgagtaaacacctaggagagggatttctgggtcaaacagaaacttcgtgattaatattttggagaaatgtcactctgctttccaaagtagctgcaccattttcccatcccatcaacaatgtacgaggaattcagcttcttcatgttcttgccattgttcattattttctgttttctttttactatggccattctggtgagtgtgaagtggtatcttattgtgcttttgacttctatttccttaatgattcatgatattaagtatcttttcatgtgtttaatggccatgtgtgcatcttctttagaagaatgtcaattcagagcatttgttcattttcatattatgtctgtgtgtctctttgttattaagatatgtgttctttataaatattgaatacaagtcttttatcaaagatataattttcaaatatgttctcccatcttatgggttgtgtgtttacttccttgatttacttccttgattatatccttcacagagataaatcccacttggtcatgatgaatgatttttctagtgtattgtcaaactcggcttgctagtattttgttgaagatttttgtgtcactatcaatcagtgatatcggcctatagttttccttttttgatgtgtctttatctggttttggatcaaggtagtactggtctaatgaagttcaatttatgttttcttttgtcacttgtactgtggtttcatagtcaaggaaccactggttaacaccaaactcgtgaaaatttacctttaagttttcttctaataattttatagtctcaagtcttattatatttacgtatatgatacattttgagttaatttttgtgtatggtatgaggcaggggtcaaatttcaccattttctttgcccattgccttgtcttggcactcttgttgaaatcaactgacaatatgtgtaaggtttatttctggattctcaattctatttcatttatttatatgtatatccctacaaaagagccaaactcaaggccataaacacatcaatcacctcacagtttcctcctgccattgttattattattttgttgagggaggtaaaaacacttaacaagcagggtatggtggctcatgcctgtaatcccagcactttcggaggccagaggattgcttgagcccagaagtttgagatcaccctaggcaacatagggagaccccatctctattgaaaaaaaatacaaattatctaggcatagtggcacgtgcctgtgatcccagatatttgggaggctgaggttggaggatcacttgagcccaggagatcaaggctgcagtgagtcaggatggcaccaatgcactctagcccgggtgacagagtgagactccataaaaaaaaaaaagaaaagaaaagaaaagaaaagaaaaagaaagaaagaaagaaagaaagaaagaaagaaagaagaaagaaagaaagaaagagaaagaaagaaagaaacactaccttctttgcaatatagtgtggtgagctatgggcactatgctgtatggtagatctccagaacttttttttatcttgcataactaaacctttgtacacttgaccaacatctttccatcctgcccccacctcagcccttggcaactaccattctactctgtgattctatgagtttgactattttagatcccacatataagtgagatcatgtagtatatgtttttctgcgtttgggttatttcacttagcataatgttctccaaatccatccatgttgttacaagtggcaggaattccttaatttttaaggctgaatggtattttttttgtgtttatataccacaatttctttattcattcattcattgttggataattagattggttccaaatcttggctactgtaaatagtgctacaataaacatgggagtgcaaatatctcttcaagattctgatttcaatgcctttatataaccagacgtgggattactggattccatggtggttcaattttctattttttgaggaacctccatactgctgtccataatggctgcaccaatttatgtacacaattgtgtatacaatttcacttttctccacatccttgccaacacttgttaacgtttgttttttaattaatagccattctaacaagtgtaaggtgatttctcattgtggttttggtttgcatttctctaatgattagtgatgttgagcactttttcatatgcctgtaggccatttgtatgtcttcttttgagatatattgattcaagttctttgtccattttaaaatcaggttgttattattttttgccattcagttgtatgagttccttgtatatatttttaaaatattaaccccttaacaaatatacagtttgcaaatattttctcccattgtgcagactgccttttcattttgttgattgtttcctttactgtgcagagatttttagcttgatatgatcccatttgtttgtttctgcttttgttgcctgtgctttcagtatcatattttaaaaataattgccaagacgaacattaaggaactttttccttatgttttctttttcctgatagttgttcatcttatatttaagtctttaatccatttgagttgaattttgtgtatgatataaaggtccaattaattattttgtatgtggatatccagttttcccagcatcatttattaaagaagctatcctttcctcattttgtattcttggcaccctcgtgaaaaattagttgactgtatatgtgtgggtttatttctgggctctctattctattccactggtctatatggctgtttttatgccataccactctgttttgattactatagctttgtaatataatttacaatctggaagtgtgatgcctgtagctttgttattcttgctcaagattgctttgtctatttggagtcttttgcagtttcaaatgacttatagggttatttcttctatgttttattttaaatgctactggagttttggtagggattacattaaatctgtggatttcttttcatagcatgtacattttaacaatattaactcttccatgaacatgagatatctttccatttacttgtgtctacttcaatttctttcatcaatgtttcatagttatcagtgtacaggtctttcacctccttgcttaaatttatacctaagtattttattatttttaatgctattgtaaatggattttttttcttaaattcttatttggatagttcattgttactgtggagaaacacaattgacttttatatgttgatttttaccttgtaactctagtaagtttgtttactagttctaagactactttggtgcagtttttagagccacatgcatgtgtgcatgcacacacacatatgggatcatgtcatctgcaaacagagacaattttacttcttcctttccaagctgaatattttttatttctttttccttgcctagttacttcagctggaacatccactactatgttacatagaagtggtgagactgggtatccttgttttgttcttgatcttagaggaaaagctttcacctttgcactgtcatgtatgatgttacctgtgggtatgtcatatatggtttttattatactgagttacattctttatatacttgatttgttgagagtttttaccattaaaagatactgaattttgtcaaatgcttgtttctgcatctgttaagatgatcatgtgatttttatcctacattttcctaatgtggtgtatcatatttattggtttgtatatgttgaagcatccttgtatcccaggtataaatctcacttgatatgttgtgtaatacttttaatgtgctgttgaattttgtttactggtattttgttgatgtttgtatgtatgttcacccgggatattggcctgtaattttcttttttgtagtgtccttgtctaccattggtactagggtaatgctagcctcagaatgagtttggaagtgttcaactttcttccattctgggggaaaatttgagaaagattggcattaattcttctataaatgttcgataaaattcaccattgaagccatgcagccctgaatttttttttttggaagattttttattattgattctaccctcttgtaagtttctagaaatttattcatttcttctaggctatacaatttattggtgtataattgttcagagtagtcttttatgattctttgtatttctgtagtatcagttgtaatgtcccctccttcatttcaactttatttatttgagatctcactgtctttttcttagtttagctaaagatctgtcaatttcatttatgttttcaaaaaggtagtttttgttttttatctttattcttatatttatttatttaatttttaaaacaattttgttggtgcatagtaggtatacatatttatggagtacatgacatattttgaataggcatgcaatgcatatagtaatcacatcatggaaaatggggtatccaaccttacaaacatttatcttttgtgtttcaaacaatccaattacactcttagttatttttaaaatgtacaattaaattattgttgactatagtcaccctgttgtgctagcaaatactaggtcttattcatttatgctagataatttttgtacccataaaccattcctacctctcccccaacccccacttccctttacagcctctggtaaccattcttctactctctatctccatgggtaaaattattttgatgtctagattccataaataagtaagaacatgtgatgtttgtctttcgtgcctggcttatttcacttagaataataaccactggttccatccatatcattggaaatgactgaataccattatttttatggctgagtggtactgcattgtttacatgtaccacattttctttatccattcatctgttgatggacacttaacttgcctccaaatcttggctattgggaacagagctgcaacaaacatggaagtgcagatatctctttgacatactgatttcctttcttttgggtatatatccagcagtggaattgtaggatcatatggcagctctatattggtttttttgaggaacctccaaactgttctccataatggatgtgttaatttacattcccaccaacagcgtatgagggttcccttttctccacatcctcaccagcatttgttgttgcctatctttttgatataatagattttaactggggtgagatgatatctcactgtagctttggtttgcatttccctgataatcagtgaagttgagcaccttttcatatgctgtttgccacctgtatgtcttcagaaatgtctattcaaatattttgcccactttttactcaaatcattagtttttttcccctacagagttgttcgagctccttatatattctgataattaatcccttgtcagatgagtagtttgcaaatattttctcccattttgtgggttgtctcttcactttggtgactgtttcctttgctgtgtagaagctttttaacttgatgtgatcccatttgtccatttttgctttggtatcctatgcttgtgaggtattactcaagaaatctttgcctagaatgatgtcccagagaatttccagttttcttgtagtaattctacagtttgaggtcttagatttaagactttaatacatttgtatttgatttttgtatatggtgagatatagtgtgatacggtctgtctagtttcattcttttgcatatagttatggatatccagttttttcaacaccatttatttaagagactatcctttccccagtgtaggtatgtggattttttttccgagttctctattctgttccattggtatatgtgcttgtttttatcccagtaccatactattttggttattattgctttattagtataatttgaagtccgataatatgatttctccagtttgttctttttgcttaggatagctttggctatactgggtcttttgtggttccatataaattttaggacagtttttttctatttctgtgaagaatatcattggtattttaatggagattgcattgaatctgtaggttgctttaggtagtcttgatagaaattttaacaataaggattcttccattcaatgaatatagaatatctttccatttttttggtgtcctctacaattttgtccactgatgttttatagtttttatgatagagatctttcacttcttaagttaattcctaggtatttcattttgtttgtggctattgtaaatgtgattacttttttatttctttttcagattgttcactgttggcctatagaaatactactgatattttgttgctgattttgtatcctgcaactttactgaagttgtttatctgttctaatagttttttgtggaatctttagggtttttaaaaaaatataagattatttcatctgcaaacagggataatttgagttcttgcattccaatttagatgtcccttagttcttttacttgtctgattgctctagctatgatgcccagtaacagtgagtaacagtgagtaacagtaacagtgagtaaaagtgggtatctttgtcgtgttccagatcttagaggaaaggctttcagttttccccattcagtatgatactagctgtgggtctgtcatatatggctgtcattatgttgaggtacgttccgctatgcccagcttattgaaagtttttatcatgaagggctgttgaattttatcaaatgctttttcagcatttgaaatgatcatatggtttttatcctttgttctgttgatatcacattaatttatttgcgtatgctaaaacatccttgaatgcaagggataaatcccacttggtcatgatgaatgatctttctaatgtattgtcaaattcagcttgctagtattttgttgaggatttttgtgtcactattcatcagtgatatcggcctatagtttcccttttttgatgtgtctttatcgggttttggatcaaggtagtacaggtctaatagaatgaatttgaaagtattccctcttttgctatttcttggaatagcttgagtaggactggtattcattcttctttaaatgtttggtagaattaagcactgaagccattgagtaccgggcttttctgtactggaaaactttttcttagggctttgatctcattacttgttattagtctgctcaggttttagatttcttcatggttcaatcttggtaggttgtatgtgcctaggaatttgtccatttcttctagattttccaatttattggcctgtagttgctcaaagtagccactaatgatccttttaatttctgctgtatcagttgtaatgtctcctttttcatctctgattttatttatttgggtcttctctctttttctcttagtctagctaaaaggtttgtcaattttgtttaacttttcaaaaaaacacaactttttgtttcattgatcttttgtattgttttcttcacttcaatttcatttatttccccctctgatctttattatttcttttcttcaccagttttgggtttgatttgctattgctttcctagttctttaagaagcatcactacgttgtttatttggcatttttcttttttaatgtaggcacttacagctataaactattagtactgcttttgttgtatcccataggttttggtatgtttcggtcccattatcattagattcaagaaaattttcaatttccttcataatttcttcattgactcatttgtcatccaggagcatattgtttaatttttttgtatttgtatagtttccaaaattactcttgttattgatttctagttttgttccattgtggtcagagaagatgcttgatattatttcaattttctaaaaatgttttatgacttgttttgtgacctaacatatggtctatgcttgaaaataatccatgtgctgagggaaaaaatgtgtattctgcagctgttgaatgaaatgttctgtaaatatccattaggtccatttggtctatagtgcagattaagtttgatgtttctttgtcaattttctgagtgcaagatccgtccaatgttgaaagtaaggtcttgatgtctccagttctcattgtattggggtctgtttgtctctttagctctaataatattggctttatatatctgagtgctccagtgttgggtgcataaatatttaaaattgtcatatcctcttgctgaattgacctgtttctcattatatagtgaccttttttgtctcttcttacagtttctgtgttgaaatctattttgtctaatataaatatagctactcctgctattttttggtttccattggcatgtaatatctttttccatccctttattttcagtctttgtgtttctttataggtgaagtatgtttcttgtaggcaacagaccactgagtcttggtttttcatccattcagccactttgtcttttggttggagagtttagtccatttacagtcaatgttattttgataagtaaggacttaatcctgccattttatttgttttatgattgttttgtggttttctcttccttctttcctttctgtttttcttttagtgaaagtgattttctattggaatatgatttagttttttgcttttaatttttttatatctgttgtaggttttttggtttgacgttaccatgaggcttgcaaatactatctcataacccattattttaaggtgataaaaactcaacactcattgcataaacaaacaaacaagcaaaaaaaacctgataaagactctatgccttaacttagccctctgcttttttaactttttgttgctactgtttatctcttattgtgctatgtcttgaaaacttgtagctattattttttattggttcatctttcagtctgtctacttaaaagtagtttacacaccatagttgctgtgttataatattctgtgttttttgtgtacttatcattgcaagttaatttttatcttcatataatttcttactgcttattaatttccttttctttctgatcgaagtactatctttagcattgcctataggacaggtctagtgttgatgaaattcttagcttttctttgtctgagaaagtctttatttctcctttatgtttgaaggatattttcaccaaatatgctgttctagggtaaaagatttttttccttcatctctttaaatatgtcatgccactctctcatggcctgtaagatttccactgaaaagtttgctgttagacatacttgagctcaatcatatgttatttgtttcttttctcttggtgcttttattattatattatatataatatatattaatatatatattaatatatattatattattattaagaaagaatcctttctttgtccttgtcatttgggagtctgattattaaattccttgaagtagtcttctttggattaaatgtgcttggtgttctataaccttcctgtacttgagtgttgttatctttctctagttctggggagttatgtgttattatccttttgaataattttctaaccctatctctttctctacctcctctttaaggcaaataactcttagatttgcctttttgaggctattatctagatcctgtaggcatgcttcattgttttttattcttttatcttttttctctcctctgtgtattttcaaatagcctgtcttcatgatcactggttctttattcttcttgatcaattctgtgattaaaagactctgatacatcctcagtatgccaattgcatttttcagctccagagtttctgcttgattctttttaattatttcaatctcttcattaaatgtatttgatagagttctgaatttcttctctgtgttatcttcaatttctttgagtttcctcaaaacaattactttgaattctctgcccaaaaggtcacatatctctgtttctccagggttggtccctggtgcctcatttagttcatttggtgaggtaatgttttcttgtatcatctttatacttgtagatgttcatctgtgttcggttactgaagagttaagtatttattgtagttttcacagtctcagcttgtttgtacccaaccttattgggaaggttttccatatatttgaaagaatttaggaattatgatctaagctgtatctgctttagagaataccccaagcccagtaacactgtggttcttctagactcatagagacaccaccttgatggtcttggacaagatccagaataattctctggattaccagagattcttgttctcttcctttactttctcccaaacaaacagaatctctctctctgttctgagccacctggagctgagggtagtgtgacgcaagcactcctgtggtcaccaccactagaactgtactgggtcagatctgaagccagcacagcactgagtctcacccaagtcctgctgtaaccactcactggctactgcctatgtttgctgaaggccctagggctctacaatcagcaggcaccaaagctagccaagcctgtgtccttcctttcagggtagtgagtttcctcaggtgggcctaggggtgccattcaggagccaggaactagagtcaaaaacccttgaaggctacctggtgttctgttgtactgcagctgagctggcactcaaatcacaagatgtagtccttcccactcttccctccctttaccaaaggcagaagaagcttattccatggccaccccccatctcaggtccatgaggagtactgccaaactaatgctgatattctcttaaggcccaaggcctcttcagtcagcttgtggtgaatgctgccttgcctgaggctcacctttcaggacagtggacttccttctggcccagggcaggtccaaaaatgccattcaagagccaagtcctggaatcagggacccaaagagcttgcttagtgctctaccctctgtttccaagctggtacctaaggtacaagacaaagtctgctttacttttccctctgcttttctcaagcagaagtagttttgcccccatagccaccacagatgggaatgtgctgagtctcacctgaagccagcacatctcacacctgactcagcacacctgagtcacacccatagtccttgacataggacctgggtattgctgctggttattcagtgcccaaggactcttcagttagcagatgatgaatcctgtcaggactgggtcattccctttaaggcagtgggttcccttctgacccagggtgtgtctagaaatgtcatctgcaagctagagcctggaaaggaggccttacaactctgctgtggcttagctggtattcaagatgcaagacaaagtcctccctgctcttcccttccctcttctcaagtggaaggaagaggggtctcttttggagctttgagctgtgcagcttggggttaggagaagggtgatgccagcacttccttagccatcctggctggtgtcttagtaggttgtgtgcctcccccctgccaccaagtacactggctttgggaccagttcagcactaggactgactcaggagttgtagtccttgtggcctagactacctttcaactttatttagggcctcagagcactttagcttgagatggcaagacatgccagaactcaagttctgatgctggcatcgacaattcccctctgctatggctggttaaattctccctctatgggcaggagttagctaagtttggtctagttttgctttctcctataacaagggcagcattgagttcaatgcttcatatttgctggctctccctctctccaacccacagaaacactctctgcaccacaccacaactgttgggagataagggagggatggcatcgacgattcaagactgtttttcctacctcttcagtgcctttcagggatatgaagttaaaaccaggtactgtgggtaatgacctgatttttggctcttatgaaagtgttttcttttccatttagatagttgttaaattggtgtccttggtgggggaacaatcagtggagtcttctattttgccatcttgctctgccagcaaaatcttaactttttttcaatcttttagattattttgctggtctctatttcatttattcctgcaccaatcttcattatttccctcctcttgctaactttgggtaagaatattgaaattatattatgtatcttttctgaccacaatgttatgtttttccaaacctcttatggacatctcatttcacagcttttcctttggaattacagtcagccctctgtatccatgggtccaaatccatggattcaaccaatctggataaaaaatatttagaaaaaaattccacaaagttccaaaaagtaaagcttgactttactgtgcatcaagtattacattgaatccacatgaattaagaaatctgtaggtattatattaactattataagtaatctagtggtgatataaattataaagtatatgcaaatactccaccatttcacataggagacttgagcatctgcggattttggtatccacgggggttctgataaccaaacccccacggataccaagggatgactaaatttggtctgcttcttgttttcgatttctattatggctatctcaggcatctgttgtattaaacaattaccattgatagtttttgagaaatggccctagatgtaaacctgtttgcattgagtgagccctgagttatgcaggtcacatgaaaacaagtgctaggagtaaaggttccagggaactatcagactggtcaaataatgacaattctctgggaatgatgtttttagggtggactaaatctgttctgccactttccaagtggttgatagcctgctagttttcatcttttttgcagggatgtttgtttctagaattactgcatagctggggcagggggatgggattaggttaagttaaaaccccacaaaacttgctgtgcttagtgagtcattcagttttcttaaataaatgttttttgaattgttgtaagcctttggataatttccaaactataaattctgaattcaatgttgattataacttccattattgattctgaattcagaaaattttgactctgattatttttgtctaagttcttgttgcttttatggaggcttggatgtatgaaagtcctagcttcatcattctctctgatccatactgttagcttttacattttgggctttgctccatactgagttaagttttgtgtatgatatgaggcaaggatattttctcatccatattattattcagttgactttgaatttacatgtatatttatattatttgaaatcaactttactgacatttgagttacatagaatcaaatgaatccactttacatgtttagtttgatgacacaaattaaaccatccatttaatcactattatacgggaagtttctatcaccccaaaaagaaagtttccttatgttgctttgcagtaaatcttctcctacatccagttataagcaggcactgttctgctctctttctttttttttttttctttttgagacatagtctcactctgtaggccaggctggagtacaatggcatgatctcggctcactgcaacctccgcctcccgggttcaagtgattctcctgcctcagcctcctgagtagctgggattacaaggatgcaccaccacaccctgctaatttttgtatttttagtagagacaggatttcaccatattggtcaggctggtctcaaactcctgactttgtcatctgcccgcctcagcctcccaaagtgctgggattacagggatgagccactgtgcctggccactgttctgctttctatcactatagatttatttttttctattcttgaatttcattaaatggaatcagacattatatacattttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtcttgatctcctgacctcgtgatccgcccgcctcggcctcccaaagtgctgggattacaggcgtgagccaccgcgcccggccatatacatttttttgtgtgagcatggtgaaaagttcagcatacattttgaaatttgtccttttttgttaaggttatcagtagtttattcctccttattgctgagtaatattttgttatataaagataccacaatttgtgtactaatttacaagttggttaacttctgagttgcttccagtttttggctattatgaataaagccatgcatattcatgtactggtctttttgtggtcatcagctttcatttatttaaggaaaatacttagtgaaagaattactggctcatatgataagtaatgtggcccatcccggtttgcctgggatagtctcagatttagccctaaaagtttcatatcccagcaaagctttcagtcctaaaaacctgggacagtcggtgacagtaatattctgactttacaagaaactgctcaactctctttttttttttttctttctttctttttttttttttttttttctgacggtcttcttctgtcacccaggctggagtgcagtggtgtgatgctggttcactgcagcctcaaactcctgagttcaagtaatcctcccacctcagcttcccaagtggctgggaccacaggtgttcctcaacgtgcctggctaatttttatttttattatttttgtagagatgtggtctatctatgttgcccaggctggtcttgaattctgggctcaagtgatcctcttgtctgggcctcccaaagtgttgaaattataagtgtgaaccaccgctcctggcatgcccagctcttttctaaagcgttggcaccattttgcattttcataaagaatgtataagagagttccagttactctatatcctgaaaaacacaaggcattgacaatttttgtttgttttgtcttgtttttaaattaaaaccgtactggcaggtctgaagtgttatgtcattacagttttaacttgcatttcattgaggattaatgattttgagcatttctgcttatgagtcatttacatatgtttctttgtagagtgtttttattcatccctaagattttaaatgtattattagtaaaagtcttttgtcagatatgtatattgcaaacatttccttcctatttcttgtctttcatttcattaatggtgtttttcagaaaacaaagttttcaatttttaaaaaagttttagtttcaggggtacatatgcaggtttgttacatgggtatactgtgtgatgctgaggtttgggcttctaatagtcctgtctcccaagtagcgaacatagtaaaagttttcaattttaataaactactaatgtatcatttttaaaatttgtagtgtttcttgtgtaagaatgcttttcctaccctgaaattgaatatatatgttcctatgttttattctacatgtttcacagttttaacattcatctttaggtctataatacattttgaattaacttagtatatggtgttagttaagacttaatgttcattggtttcttaaggatatgatggttccatcactatttcatgaaaagactacttttcctccactgaattcctttggtgactttgtctaaaatctgttgatcatacatatgtgggtctatctttgtaattttcttctattcatctatgtctctttcatcaaaccaatgttgcagtattttgctgaccatagctttgaaattatgttgtgtatattctccaaacttgttctccttttaaaagactgttttggctattctaaattcttagcttttctacataaatttgggaataaaagtgtcaactgctatatcaactctactggcatttagattggggttatatatatctacacacacatatatatgtatagcaagagagagagagattaacttgctgacgtaattaaactgacatcttaatattgagtgactcagttcataagcatgatctatctctccaatgatttcaatattctttattttcagtcagcaacattttatatttttcagcatttaggattttttatatatttggataaatttatcactacatatttcatggtttttgatactactggaagtatttttaaaaatttcaatttccagttgtatattgttcatgtatagaaactcacttcctctttgaatattgacattgtgactgcatagtattgcattaggcgatatacctaatgaatattgacattgtgtcctgtgacttttctaaattgtatttattggttcttttaatgctttgaaaagatttcatatgattatctgtaaacaaaagcatgtcttctctaagggaagagtgttttctttatttacaatatatatgccttttatgaagtatattttattttcttattgcactggatagaaactccaagaaaattatgcacagaagtagtgaaagcagacatcgttgccttggtctcaattttagaaagatttcagcattttaccattaaaattatgttagcaatcagtttttcttagattccctttattaggttgatgaaaatctcttctattcctaatttactgaaattctaaaaaatcacaaatatagctatatttttcacatgatattttcctgtagttactgagatgacaacttagttatttcctttattatgtaaatatggtcaattgcattgattggtttccaagttttaaaccatctttttatacccagagtaaaccccactttttcatgacatgttatcttttttacatatttttgaattgaacttgctaatgttgtttaaaatttcttttgaatatgtacttgagaaatattggtgcatatttttcttctgtttgtctggtatttgtttcaggataacttgtctttctaagagaattgagaaatgctcctctctttcctatttcctgaagtaatttgaataaacttggtattatttctcattttaggttttgatagaataaaaagttaaagatatgagggtctggagttttctttgggaaggaattttaatttaaaattcaatttcttaaacagatatagacctattgatatttttatttttttattattttaaaaattttgtgtctttcaacaaatttgtccaattcatctcagtttttgaatttgttgaaatagaattaatatcttgttatctttttaatatctgcattatctgtagttacatttccttttttagttctgatacaatgtgtttcttttttctttataataactagtcttgtaaggattttattagttacattaatattttcaaagaaacaccttttgtagttcctttttgatgttgttgatttttatttgttgttcgtgtcctctttcattgatttccagtcttatttttattgtttacttctttatactcactttgggcttaaattgctcttttttcttttagccttttaagttagaagccagaataatcaattctaaacatttattttcaatttaatcatttaaagcaatacatttctttctaagatctgtttaagttatagcccacaaattttgatatgttgtctttttatcatcatccacttcaaaactttttctagttttccttgtgatttcttttttgacttatgaaatacttagtagtgtgttattttccaaatattcagaaattttctagataccgctgtgtaattggtttccaatttaattccatcattagataacataccgtgtataattttggtacttacaaatttattgaggccttttaaatattgcttagcatatagtctatatttggaaatgtttcatgtgcatttgaaatatatattttacagttctagggtatagtattctctgaatatccattacaataagctggctgatagtgtttttcaaatcttccacaacattactgatttctgtctacttgttctatcaattactgagagtaatgttgaaatctctgaatgtgctttggatttcttcattcttctctttagttctttaactattacttcatgtattttgaaattgtgccactaggcacacaccatttaaccactctttatcctttgttttactgttttaatcatgtctacattttctgacattaatagagccactccagagttcttatgcttatttgtgatgatgttttctttcatctttttacttttaatttatgtcttcaaatttgaaagataatttttgctgacagtattataattgggttgtaatttttgctaaacctgataatatctggcttttaatttatgtgttaggtctactgttattgaatgtaattattaatatggttgactttaagtatagcctccctctctttgttttctcttttcccttattttgttttcctttttcttgttttcagccttcttttagatgaattgaatatctcttagtattgaagttgcaccactattgacttaatggctataacttttaaaaatatttttatgtcgtcatccatgatttacaatattcatccttaatttattacagtctacttcaaataattttctaccattctatataagatgtaaagatcctagaacaatgtacaaccattatccactccatcctttgaattactgtcatataatttatttctacacatgcaataaactttacaagatggtattattaatactgagttaaacaggcaattatctttataaaaaacaaacaggagaaaagttttttatgtatatcacatatttaccatttccagtgcccttcatttctttatgtagattttcatttaacattggttttactttctttcagtctaaaaaacttcatttattgtttcctgtaatacagacatttattttgtgtgaaaatttttattttgtctttatcgttcaattatattttaactggataatgaattctgctttgagagtgttattttctttcagtactttcttccatttctggcttccacagtttttaattatattttaaaagccatttctctttcttttccgtcatggatatattatctttttctgtggctgaatttaaaattttctttttatcttacttatcggtaatttaattattatttattttgatttggttttctttttatttatttatttttaattattattatactttaagttttagggtacatgtgcacaacatgcaggtttgttacatatgatttggttttctttattttttcctcttcctttctttgtgttcattgagttttgatgagtttatattttgaacagatttggaatactttgtgtaattattcattcaaatattttcctgccccaccctcccttttgggggctcaaatttcacatagggtattgcttgatttttttttattatactttaagttttagggtacatgtacacaatgtgcaggttagatacatatgtatacatgtgccatgctggtgcgctgcacccactaactcgtcatctagcattaggtatatctcccaatgctatccctcccccctccccccaccccaccacagtccccagagtgtgatgttccccttcctgtgtccatgtgttctcattgttcaattcccacctatgagtgagaacacgcggtgtttggatttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacacacatgtgcatgtgtgtttgtagcagcatgctttatagtcctttgggtatatacccagtaatgggatggctgggtcaaatggtatttctagttctagatccctgaggaatcgccacactgacttccacaatggttgaactaggttacagtcccaccaacagtgtaaaagtgttcctatttctccacatcctctccacacctgttgtttcctgactttttaatgattgccatgctaactggtgtgagacggtatctcattgtggttttgatttgcatttctctgatggccagtgatggtgagcattttttcatgtgtgttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtggtttcttttgctgtgcagaaactctttagtttaactagatcccatttgtcaattttggcttttgttgccattgcttttggtgttttggacatgaagtccttgcccatgcctatgtcctcaatggtaaagcctaggtttttctctagggttttcatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtacaagtaccatgctgttttggttactgtagccttgtagtatagtttgaagtcaggtagcgtgatgcctccagctttgttcttttggcttaggattgatttggcaatgtgggctcttttttggttccatatgaactttaaagtagttttttccaattctgtgaagaaagtcattggtagcttgatggggatggcattgaatctgtaaattaccttgggcagtatggccattttcacgatattgattctgcctacccatgagcatggaatgttcttccatttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacagtcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagtttgcaaagggaatgcttccagtttttgcccattcagtatgatattggctgtgggtttgtcatagatagctcttattattttggaatatgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgatggtagtttgtgtttctgtgggatcgctggtgatatcccctttatcattttttattgcgtctatttgattcttctctctttttttctttattagtctcaccagaggtttatcaattttgttgatcctttcataaaaccagctcctggattcattaattttttgaagggttttctgtgtctctatttccttcagttctgctctgattttagttatttcttgcattctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtatttgagcggttttgagtgagattcttaatcctgagttctagtttgattgtactgtggtctgagagatagtttattataatttctgttcttttacatttgctgaggagagctttacttcccagtatgtggtcaattttggaataggtgtggtgtggtgctgaaaaaaatgtatattctgttgatttgaggtggagagttctctagatgtctattaggtccgcttggtgcagagctgagttcaattcctgggtatccttattgactttctgtctcgttgatctgtctaatgttgacagtggagtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggttgaaagtctgttttatcagagactaggattgcaacccctgcctttttttgttttccatttgcttggtagatcttcctccatccttttattttgagcctatgtgtgtctctgcacgtgagatgggtttcctgaatatagcgcactgatgggtcttgactctttatccaatttgccagtctgtgtcttttaattggagcatttagtccatttacatttaaagttaatattgttatgtgtgaatttgatcctgtcatgatgatgttagttggttattttgctcgttagttgatgcagtttcttcctagtctcgatggtctttacattttggcatgattttgccgcggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggataggaaattctgggttgaaaattcttttctttaagaatgttgaatattggcccccactctcttctggcttgtagggtttctgccgagagatctgctgttagtctgatgggcttccctttgagggtaacccgacctttccctccggctgcccttaacattttttctttcatttcaactttggtgaatctgacaattatgtgtcttggagttgctcttctcaaggaggatctttgttgcgttctctgtatttcctgaatctgaccgttggcctgccttgctagattggggaagttctcctggataatatcctgcagagtgttttccaacttggttccattctccccgtcactttcaggtacaccaatcagacgtagatttggtcttttcacatagtcccatatttcttggaggcttcgctcgtttctttttattcttttttctctaaacttcccttctcgcttcatttcattcatttcatcttccatcgctgataccctttcttccagttgatcgcatcggctcctgaggcttctgcattcttcacgtagttcttgagccttggttttcagctccatcagctcctttaagcacttctctctattggttattctagttgtacattcttctaaatttttttcaaagttttcaacttctttgcctttggtttgaatgtcctcccgtagctcggagtaatttgatcgtctgaagccttcttctctcagctcgtcaaagtcattctccgtccagctttgttctgttgctggtgaggaactgcgttcctttggaggaggagaggtgctctgctttttagagtttccagtttttctagagtttctgttttttccccatcttagtggttttatctacttttggtctttgatgatggtgatgtacagatgggtttttggtgtggatgtcctttccgtttgttagttttccttctaacagacaggaccctcagctgcaggtctgttggagtacccggccttgtgaggtgtcagtctgccgctgctggggggtgcctcccagttaggctcctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggccccacccagttcgagcttcccagctgctttgtttacctaatcaagcctgggcaatgtcgggcgcccctcccccagcctcgctgccgccttgcagtttgatctcagactgctgtgctagcaatcagtgagactccgtgggcgtaggcccctccgagccaggtgtgggatataatctcatggtgcgccggtttttaagcccgtcggaaaagcgtattcaggtgggagttacccgattttccaggtgccgtctgtcacctctttctttgactaggaaagggaactccctgaccccttgcacttcccgagtgaggcaatgcctcgccctgcttcggctcgcacagggtgcacgcacccactgacctgcgcccactgtctggcaccccctattgagatgaacccggtacctcagatggaaatgcagaaatcacccatcttctgcatggctcacgctgggagctgtagactggagctcttcctattcggccatctgggctcctcccccctgcttgatgtatttttactagtctttggagtcttgcttaacccttctttaagaatcatctcactagattcttcctgtgatatgacagttcatcactgactgttgtcttatatctgaaaagttgcttcatatgtttcatctagttttctagttttttatggtgagggtactagacttctgcagtttactcctcacagctagaatagacattacattttattgtctttttcccatctgtgtcttttaacaagcagaaatatttttattttgattaagtccaatgtgtcattttagaaatgttattttactctttttttgtctcttctctgtataattttttcctactcaatgtttatgaagttctttttctgtgctttcttccataaactttgtagtcctagttttccatatttagttctgtgctccatcttgaatcaagttttttggtgcgatataggggttatggctcattttttttctatgtagatttctggcatcatttgttgaaatctttcttttctgcattgagttccctttgtgctattttggaaaatgagttgcttttgtatatgcgggtctatttatgtgctttctattctgttttgttaatacacttgttcattcttaggcctataccatactgtcttattttctgcaactttatggtaagacttgaaatctggtaggttgaatccttcaactttgtttctttataaaagtcttttttggctattttagtgtctttacttttccatataaattttaaatcagcttatcactctcttcaacaaaacctgatgggattttgattgtaattatattatatctttagatcaatttggaaagaattaaaatcttaatattgagacatataatcaatggcaattttttcccatttattttaattgtctttaatttctttcaccaatgtgttgtaatttttaagtgtaaagatattgcattttttaaattaaacctattcctaagcatttcatgatttaaaaatctcattgtacatggcatttttgattcccttttctaatttttggaaaaaattgttttatggcctatatatataaatgtgattaattttcatttattcattttataccctactcccttataaattcaattagtagttctagggttttttgttgtttttgttgttgtagctttctttgtagattccacaggattttctgtacatacaattatctcatctatgaataatgacagttttactattttttctccaatctttcagatttctacttttttttgtgttattgaaccggtttggacctccagtacaatgttgaatgtaagtgatgagaattgatttcattgcttttctcacacttagttaagaaggcaatgaagatatcaccattaacgtcatgttaactgtaggtttttggtagacgccctttatcacattgagtaagttcctgcatacattgtttaatgacaggggtacattcttgacggggatacattctgagaaatgtgtcgttacgtgatttttgtcattgtgtgaacatcatagagtgtacttacacaaacctaaatgatatagcctactatacacctaagctctacggtgtttttcagctccattatctactgctctgaggctacaaaactgtacatcatattactgtactgaatactacaggcaattgtaacacaatgtaagtacttgtgtatctaaacatatctaagcatagaaaaggtatagtaaaaatacagtataaaatatttgaaaatagtactcacgtatagggcacttgccatgaatggagcttgcaggactggaagttgctctgagtgagtcagtgagtggtgaatgttaaagcctatgtcattaatgtacactactgtagactttataagcactgtatacttaggctgcagcaactttataaaagaatattttcattcaataataaattaaccttagcttactgtcacataataatttttaactttttgactcttttgtagtaacacaacttaaaacacaaacacatggtatagctgtacaaacatattttatatccttattatataatgttcttactatttttatttttaaatatttaaacatctgttaaaaattaagacacaaacacacacataagcctaggcttacacagggtcaggatcatccatattgctgtcttccccctccacattttgtcccactggaaggtcttcagggacaataacacatggagctgtcatttcctatgataaaaatgccttcttctggaatacctcctgaaggacctgcctgaggatactttacagttaactttttaaaaaaatataaatagaagaaatacactctaaaatagtgataaaaattatagtaaattcataagccagtaatatagtcatttattatcattatcaaatattaggtattgtacataattgaatgtgctagacttttatatgacctgcagtgcagtgagtttagttacaccaccatcaccatgaacaaatgagtaatgtattgtgctatagaatttttcagctccattattatcttatggggtcactagcatagataggtatgtggcttgttgttgaccaaaacattgttacaaggcacatgactatacctactagttttctgagagcttttataatgaatagattttgaattttgtcgaatagtttttctccacctattatgcattctttttctcattttgttctgttaatatggcaaattaagactgacattgatacaattcacttatcttactcaggtttccccagtattacttgcactcacttgtgtatgtgtgtacttagttctataaaattttatcatgcttttaggtttctgtatccactaccagtcaagataaataacaatttcatcacaagggtaccttctattatagctacagctgcctccctcctgctatttctctcatccctaacccttaacaaccactagtctgttcttcattaaaaaatattttgttatgtatttatttatttatttatttattttgagacagagtctcactctgtcgcccaggctggagtaaagtggctcaagcaatcttcccacctcagctctcctagtagctgggtccacaggcacacgccacaatgtctgggatcttaaatttttttgtagagacagggtctccctattttgcccagggtggtcttgaactcctgacctcaagccatccccctgccttgacctcccaaagagcagggattacacacatgaaccactgtacctggccccaaaatgttttataagtggaatcataggtatgtaatcttatgggattgacaagttgtatgtatcaatagtctgtgcctttttattgctgagtatattgtaccgcagttttactattcacctgttgaagaacacctgggttgtttccggtgtttgactattatgaataaagctgctacgaatgttatgtactggatttggggtgaacatatgttttcatttctctgagttaaatgccaggaagtgcgattgctgggttgtatagttgcatgtttagttttataagcacctgccaaactgtttcccagagtgactggggttgaactgtgttctcccaaaatttatatgttaaagtcctcacccctcataactcagaatgtgaccttacttggagataagatctttacagaggaaatcaagttaaataaggtcattagggtgagctctaatccaatatgaccagtgtccttatcaaaaggggaaatttggatacagagacatgcattgaaggaagatgatgtaaagagacacagggagaagatgaccatctacaagccaaggagaggggcatggaacggattcttccctcacagacctcagaagggactaatcctactgacatcttgattttggacttctagcatacagaactgtgagacaaaaattttcttttgtttaagccacccattttgtggtactttattacagcagcactagcaaacttatagaggctatacaattttacattttcaccagcagtgtataagtgatccaattaattcacgtcctcactagaattttatgttgtcactgtattagtctgttctcacactgctaataaagacatacaagagactgggtaatttataaagaaaaagaggtttaatggattcactgctccacgtggctggagaggcctcacaatcatggcagaaagtgaggaggagcaaagtcacaacttacatggtggcaggcaagagggcatgtgcaggggaacttccctttttaaaaccatcagatctcctaagacttatccactatcacgagaacagcacagggaaaaaccctcccccatgattcaattacctcccactgggtcctcacacaacacgtgggaattgtgggagctacaactcaagatgagatttaggtgggaacacagccaaaccatattcgtcactatatgtaatattatacataatttaatatataattatatatgtatgtaacttatgtataattatatatacatataatcttctgtctcttaatatatatacatataatattatgtataattatatatacatctaatttttttctttttaatatatatatttttattatactttaagttctagggtacatgtgcacaacatgcaggtttattacatatatatacatgtgccatgttggtgtgctgcacccattaactggtcatttacattaggtatatctcctaatgctatcccttccccctccccccacctcacaacaggccctggtgtgtgatgttccccttcctgtgtccaagtgttctcattgttatatacatataattttatttttttagggatggaatctcgctatgttgcccaggctggagtgcagtggctattcacaagtatgatcccactacttatcagcatgagagttttgatctgctgtttccaatctgggcaggttattcctctccttaggcaacctggtggtttccttctcctgggaggtccccatgttgaagctgaatactgaacttagtgcagacaaccaatcagcatagggcacctcagcccagaactcctgggctcaagcaatcctcctgcctcaggctcctgagtagctgggtctacaggtgtgtgccatcacgtccagttgtcactatatttttatttttgccattctgatagatgtgcagtgatatctcactgtagttttaacttacatttcaccgatggctaatgatgttgaatagcttttaatgtgcttatttaccatctgtatattctcctcagtgaaatgtctgctcatgtcctctgctggttttctcattggattttttaaatgttgagttttcaaagtttttgtatgttatagatattagttctttgtcagatagctggtttgcaaatacttccttcaaatctatgccttattttcatgttcttcacctgggcttttgcaaaagagaatttttaattttgatgatgtccagtttgttaatttattattttatgcattatgcttttggtgttaactctaagaattaattccctagccctagatcttgcagttttctcctatgatttttatagacgtcttataggtttatgttttaaatttaagttaatgtttgatttaaattttacataaggtgtgaggtttgaattttcagttgaagttgtctctgtgtgtgtgtgtgcatgcgtgcacacatgtttgtaattccaattgctccaacactatttgttagaaggactatacttgctttattgaattgtcttcacatctttgtcaaaaatcagctgagcatatttgtgtgggtccatttcagagttttctattctgttcattaacctagaaaagaaaacaccaacaaatccaaccatatcctatctataagagatgtaatttagattcaatgatacatataggttgaagtaaaaggatagaaaataacatacttacaaatatcaaccataaaatacctggagtggtgatactaatatcggaataataaataaatttgttcttatgacaggatgtccctttgtcacccacgctggaatgcagtggtgtaattgcagctctctgtggcctcaaactcttgggctcaagggattctactgcctcagccccccaagtagctgggactacaggcatgtgccaccatgccaggctaatttttaaaatttggaaagataagttctcactatgttgcctaggcttctctcaaactactggcctcaagttatccttcttcctcggcctgccaacatgctgggattataggcgtcagccaccgtgcccattctaatatcagaatttaaacagaatttaatacaaaaaagtgtcaccagagataaggaggaatattatataataataaaatggtcaactcctcaggaagatataacatttttatatatttatagataattattttatatatttattttacatataatatatagatattattttatatgtttatatataatatatagataatattttatatatttattttatatataatatatagatattattttatatattgattttatatataatatatacatattttatatatttatagagacatgttttataggctagcaaggctagcatatggtctatgctggagaaagtttcatctgcgctagagaacaatgggcattggctattgctgggtagaatgctgcacagatttgtcttaggtctaattggtctgtctgttattgaaagtgagatattgaggtctcccatgattactggtgaattttctgtttgtctcttcatctatttttgttccatttatttttaggaatatatatatatatatattttaggaatatatttaggaatgtatttaggaaatatttaggatacatttagaatatatttacgaatatatttaggaatatatatatggaatatatatatggaatatatatatggaatatatatatggaatatatatatggaatatatatatggaatatatatatggaatatatatatggaatatatatatggaatatatatatacggactatatagttggaatatatatacggaatatatagatggaatatatatatacggaatatatagatggtctatatatagatggaatatatagatggactatatagatggactatgtacagatggaatatatagatggaatatatatagatggaatatatatagatggaatatatagagatggaatatagagatggaatatatagaaatggaatatatagatggaatatacatagatggaatatatagatggaatatatatagagggaatagatagatggaatatatatagagggaatatagatggaatatatagagggaatatatagatggaatatatatagagggaatatatatacggaatatatatacggaatatatatgtatatgtatacggaatatatatacggaatatatgtatatgtatacggaatatatatatacagaatatatgtatatgtgtacggaatatatatagggaatatatatatgtatacggaatatatataccgaatatatatatgtatacggaatatatatgtgtatacggaatatatatatacggaatatatatgtatacggaatatatatataccaaatttatataaacgcggactatatatatatacagaatttatatatacgcggagtatatatatatgcggaatttatatatacacggactatatatatggaatttatatatacgcggactatatgtatatgcggaacatatatacgcggactatatgtatatacgttacatatatacgcggactatatgtatatacggaacatatatacgcgtactatatgtatatatggaacatatgtacgtggaatatatgtagatacggaacatatatacgcggaatatatgtatatacggaacatatacgcggaatatatgtatatacggaacatatacgcgaaatatatatatacacggaatatatatatacacggaatatatatatacacggaatatatatatgtacggactatatatagacacggaatatatatatgtgcagactatatatagacacggaatatatatatgtgcggactatatatagacacggaatatatatatgtacggactatatttagacagaatatatatatgtacggactatgtatatacacggaatatatatatatgtacggactatatatatacacggaatatatatatatgtacggactatatatatacacggaatatatatatatctacggactatatatatacacggaatatatatatacacggactatatatatacatggaatatatatatacacggactgtatatatacacggaatatatatatatacggactgtatatatacacgaaatatatctgtacggaatacatacatacacgcaatatatctgtacggaatacatacatacacggaatatatctgtacggaatacatacatacacggaatatatctgtacggaatacatatatacacggaatatatctatacggaatacatacatacacggaatatatgtatacggaatgcatacatacacggaatttatctatatggaatacatacatacacggaatatatatatggaatatacatatacggaatatatatacggaatatagatacggaatatatatatggaatatatagagatggaatatagagatatggaatatatagagatggaatatagagatatatggaatatatagagatggaatatagatatatatggaatatatagagatggaatatagatatatatggaatatatagagatggaatatagatatatatggaatatatagagatggaatatagatatatatggaatatatagagatggaatatagatatatatggaatatatagagatggaatatagatatatatggaatatatagagatggaatatagatatatatggaatatatagagatggaatatagatatatatggaatatatagagatggaatatatagagatggaatatagatatatatggaatatatagagatggactatatagatatatggaatatatttatggaatatagatatggaatatatatatggaatacatgtatatggaatatatatatggaatacatgtatatggaatatatatatggaatatatatggaaaaaatatacatatatggagtatatattgaaaaaatatatggaatatatatgtatatataaaaaatatatggaatatatatgtatatatggaaaatatatatatatggaatgtatatatatatattcctaaaaataaatgaaacaaaaacagatgaagagacaaatagaaaattcaccaataatcatgggagacttcaatatctcactttcaataacggacagaccaattagacctaagacaaatctgtgcaacattccacccagtaatagccaatgctcatttttctgtagcgcacatgaaactttctccagcatagaccatatgctagccttgctagcctgtaaaacatgtctctataaatttaaaattactgaagccatacaaaatataatctatgaccaaaatggaatgaaattggaaatctataacagaattaaaaatggtaaatttacaaatatgtacttctagctcatctccccaagaagtatcattgagctaccagccttctcttaacttgtcaccaccaaaattgttttcaacaataccttaagtttgaatttccttacacactttaaaaaataaagccagttcccttagtctgagctgtagagttctgctattttatgtcttgccttttcccttgggcagaatttctgtgctattgcaagggagcctggggtaaggatagcagcatgcttctcctagagtgacaccccagctctaggagcagtgatcgggttttgaaggtagtccctggtcttttctacttgaaatgtgcaacctctacccttctagagacctaggtcaggtgtgttcagggcagagtatactatgcctgctctgactgaagtaaaacttccaccccataagtaggcattgagtcgggggaaggaagactggcctgctgtaactgcccagaatagaacttctgcaatatggaacttggggtgatgactgatgctggtggcctgcctcacatagggtacaactgtaaccctagattgggagctaggtagagagggagcccatcttcttaattgcagatgcctggagtagaatttccatcacagtgagctggtagtgatggggatataaacatgccaaggctcaagtgtcacggattctcattgctcttacagagagttagataattttcttgattagatgtttttctatttgctttaggctcttaggacaatttccaaatactttaaatgttttttcaaaaaataatttgcagcagtaaaatggttgttttgctggggagaatgtccactgtgcacttaagcagccattctggaagttcatccagggttgattttttttccatagatatattcacttgactcagaactatactgaacgaaccattatttctccaaagtactgcagtgttttcttgttataaatcagatgacagtatatgtgtgggtttaattctggactctagattttgttccattaattagtttgattatccttttgccaatactatgccctctcaattactattcctttataatagggatttttatctggtagtaaattcctcttgtttggtccttttctatgaaatacccattattcttgaccctttgcattttcttataaattgtagaatcacctagtaaattatccaaaaacatactgggattttcactgcgactctgttgaatctatattaattaaagaagattttacatctctttgttttgagattttacatcttagcaatatttagtcgtatgatccataatatagtctctctctccatttatttatgtctttttttctcgaaatgtgataagtttcagcataaatttttttcatgcctgttatcagataaatttctaggcatttgatttatttgatttgttaatagtgtctgtatcagtcagggttccaccagagaaatatatataccatatacacacacatatacactgtatgtatactttctctctctctctctctctatatatatatagatagatagatagatagatatagagagagagaaggggaagggagggagatctatctacctatctatctatgtgtctaagttattctcctttacttaaagtcagctgattatacatgttaatcacatatatgtaatacattcacatcaatacccagatttgtgtttgattgaatagttggagactatagcctagataaagtggacatatagaaattaccatcacaatgccgtttctttatgaaaattggaccattcagatttcctatatattattctttcctcacagtattctaaggttaaattttactgttgttttctaacttcttgaaatgtaaaagtccaaattattgatttagttctgtattgatttagttctagtctttcttcagttctatagatgagatttcacacttataaaatttcttctaatatctactaaagctgcatatcagaaattgcaatatattcattatattctacttcgaaatgttttctacttttacttgtgatatcttccttgatccattgactatttcatagtacattgtataattcacaggaaatttagaattttgtatttattattttgttgttggtttctagattacatccactgaatcaagacgatactctgaatgatttcaatctttataaacttgtcaaggctttctttgttgccaagcatgtgatcaattttgttaaatgctccccacatactttaaaagaaaatgagtcctgctattgttgcgtgtagtgctgtatgcgttataattaggtcacgtttcatcatgttcatcaaaattccttgcccttactctttttttgtgtgtgtaagtgttttattgatttctttctctagtatttttggatggagcgcttgtccatacaactaggaagtagaagtccctacattccctggaatcaaataccatatatacagtgtcagctcccaaatagatttcaaatgcagatctttcacttcaattaaggctcatatatttaagtgttcactaaatatttacatatgtctcagacacttcacatttatgttaaaactaaaatcatcatctttcccctaaattatccttatttttccatcttaccaatagaattgtcattgattaagttgctcataaagaacaaaatgagagtattatcattagagtccattcctgatgtctcatagcacatccagaaagtcacgaagtcctttaccacattcatttatcagaactaggagctttttgggttagtctttagggttttctaggtgtacgatcatatcatcagcaaacagcaacagtttgacttcctctttaccgatttggatgccctttgtttctttctcttgtctgattgctctggctaggacttccagtactacactgaatagaagtggttaaggtgggcatgcttgtcttgttgcagttctcagggagaatgctttcaacttttccccattcagtataatgttggctgtgagtttgttatagatggcttttcttaccttaaggtatgtcccttctatgctgattttgcagagggttttaatcataaagggatgctggattttgtcaaatgctttttctgcattggtaaagtttcaggatgaaaataactgtacacaaatcagtagcactgctatacaccaacagtgaccaagctgagaatcaaattaagaactcaacctcttttacaacagctgcaaaaaagtaaaatacctaggaatatacctaaccaaggaggtgaaagacctctacaaggaaaactacaaaacactgctgaaagaaatcataggtggcataaacaagtggaaacacatcccatgttcatggatgggtagaatcaatattgtgaaaatgaccatactgccaaaagcaatctataaattcaatgtaatttccatcaaaataccgtcatcattcttcacagaagtagaaaaacaatcttgaaattcatatggaaccaaaaaagagcccgcatggccaaagcaagactaaacaaaaataacaaatctggaggcaacacgttacctgacttcaaactatactacaaggctatatttaccaaaacagcatggtactggtataaaacaggcatgtagaccaatggaacaaaatagaggacccagaaataaagccaaatacttacagccaattgatctttgacaaagcaaacaaaaacgtaaattgggaaaagggcaccctattcaacaaatggttctgggataattggcaagcctcatgtagaagaatgaaattggatcctcatctcctactttatacaaaaattaactcgtgatagatcaaaaacttaaacctaagacccgaaaccataaatattctagaatataacatcagaaaaactcttctagacattggtttaggcaaagagttcatgacaaagaactcaaaagcaaatgcaataaaaacaaagataaatacatgggacttaattaaactaaaaagcttctgcacagcaaaagaaacaatcagcagagtaaacagacaacccacagagtgggagaaaatattcgcaaactgtgcatccaccaaaggactaatatccagaatctacaaggatctcaaacaaatcaacaagaataaaacaaattgtctcatcaaaaactggggtaaggagatagacaattctcaaaagaagatatttaaatggccaaaaaccccatgataaaaaatgctcaatatcactaattatcagggaaatgcaaatcacacccacaaggtgataccaccttattcctgcaagactggctaaaattttaaaaaatcaaaaaataatagacgttggtgtgaatgtgatgaaaagggaaaacttttacactgctggtgggaatgtaagctagtacaaccactatggaaaatagtatggagattccttaaagaatgaaaagtagaactaccatttgatccagcaatcccactactgggtatctacccagaggaaaaaagtccttatgtgaaaaagacacttgttcatccatgtttatagcagcacaatttgcaattgcaaaaatatggaaccagcctaaattcctgtgaaccaataagtagataaagaaaatgtgcctagttgatgggtttatctgtgaggcaaaccatcatggcacatgtttacctatgtaacaaacctgcacatcctgcacatgtacagtggaacttaaaataaaagttgaagaaaacaaagaaaatgtgctatatgtatataccatagaatactacttagccatataaaggaataaaataatggcatttgcagcaacctggatggagttggagaccattattctaagtgaagtaactcaggaatggaaaaccaaacatcgtatgttctcacttataagtgggagctaagctatgaggatgcaaaggcataagaatgatgtaatggaggccgggcacggtggcttctgcttgtattcccagtactttgggaagccaaggagggtagatcatttgaggtcaggaattcgagactggcctagccaacatggtgaaaccccttctctgcaaaacatacaaaaattagctgcgtgtagtcacgtgcctgtagtcccagctactggtgaggctgaggcaggagaatcgcttgaacctgggaggcagaggttgcagtaagcagagattgtgccattgcattccagcctgggtgacagagcgagattccatctcagaaaaaaaaaaaaagaagaagaagaggaagaatgatataatggattctggggactcggatggaacggtgggagttggaggcgggataaaagactacacattgggtacagtgtacactgctcgagtgatgggtgcaccaaaatctcagaaacatcactaaagaacttctccatgtaaccataaaccacttgttcttccaaaactattgaaataatagaaaaataaaaacttttaaaagaaagtcacaaagtctttagattctaccttgttgacatctctctgatccatctgttctctatcctcactgatattgctccatcatcccctgtttgaaccctttcaataacttctaattgaccttcctgccttcagtcttgttctctttaatttgccctccatgcaactgccagggttatctttataaatcataaatctaactcattatttctctgcttaacatacttaaattgcttcctattacctgcaagatgcatttcaaacatctaacttttgcaacaaggttatttttttcatggagtgtcctcttgtatttcatctcacccctctgtccacttagagaacatcttttccattttgtaagaatgagttcaagtgtcaagttctctgcccaccctccactagaatcgaatgtttccgccattgttcccttactatgtacaatatggtcttctattacagaccgcctaaaaatttattttacttgcttttatatgtctgtgtcactgacccacacacccagacgctgaacaattcaacatcaagaactctgtttcgtctttaagaacaattcaacatcaagaactctgtttcatctttaaaatcagtattgaacttggcagatactagacacataataaatgttggctgactgagtaaatagcaataaaaaaactatatacaatttgttatattttcactctttcatgttaaaaatcttataaatgttaacaatcttaatttattaatctgatcatctcctatatttgatcagaaataaccttattttgtgaatagctgtgttctgtctgtgaagttctgagtgctgtaggctatgtctggtatttcagttaatcaattaagctactgtaggaataagtgagaggataaatgatttagacagaatctttaatgtgacatacctcatgagaactgcttcttcactgtacgatgtagcagagcagagagactaataacagccacataggatgatcctgagaataactttccttagaaatctcacaggctagactcgttgtcttcccaaaacccattccccttttccattctgtgtcatagtgagtggcatcactattcatgcagttgcaaaatcaaacaccttacggtcattttaaaactttctcctttttgtcatcctacatccccgaatccatcaccaagtcctattgatcttcctctaaaatatatcccaaatctgtccatttcattttattttcactgccaccatcctcattcaaggtaccattatataagtccttaccatagtgctgtagatttcgttctctcctgtctcaccaatagactatgagctccccaagggcaatggatatttctgatgctctatccttctgggaacatgttgccctcaaatatgaaaatgggtataatagttaatatataatttaatatagtatatttctcccaattatcatatttgtattttaacagacgccttctagagacagtgctttaggacaatgttttccaaatggcagtctgtggaacacttgtcagaccaggttaaataactggggaagctgcaaattttatctccttggataattatatccccatttatgatgttaaaggttttgaaacatactgcaataaagcatacagtttcactctatatagcctagcattttacacacttatttaatcagagaacctcctttttcatggcatatttgttaatgttctgctgaatgatgtattttaaacacagtccataaaacgacttataagaccaacttcagacaccagctgtgcaatgtaggacagtttataaagggcaggaggggattcggttagtcctaacatcatcttggaaggttaaagatgtctcccaaatgatttcaacaaccccttaatagcttgatatagctatgggatccaaggaccaactccttaatctgttcagtgttgttttagcccagagtatctgagcaccctcagtaactttacacaatatatttttgggaatgctatgtgatccatctgtttcttttttatcccataaaaataaagtcctcttaaaattgctattcttactgctgttcattagttatgtttgattatttttccctggatagaatgaaaatcttttgaattgcatctattaattgtctttctgcaacttggcattccttagggaaaaacattccttacctcataagagggttgtggtttacgtgtgtgtttgtgtgtgtgtgtggaggcgggtggtgagcggagatattggtttgtaaatttagcatctttaccctctgtgaaaatcacaacactacttcaggttgggagcattcctggcccatggataacacttaaaggtcacgtgtctctgaccaatccttacaagtcatcactgacccaatgccatgcatatcttgccacactatcttcccgccctgtcttttacaactgtcctctatacccccttagaagaccactggcatcacatctgtcttcatagtggagccctcctggcagctttattacccacctcctatgttccaggcactgtccaaggtactgtgattgacaattgagaatgaaacggtacctgtccctgctttcccagagctcactcagttcagattttgaatgtctctctcttcactgcctctctttctcttcagctttaaaaagtgcccaggagtctctcatattgagaatgccagttgtcctctcaatgaccatctcatctcttaccttgcactgcctgaatccttttcccacaatttgtaaaataatctttctaaagcacagatttgattagtacttattctagcttaaaaacctcctttgattccccaccatctacaagctcaaacccaacttcttagtaaggcacacgagacctttcacaatatggcagcagtttggtctcttgatctaatttcccgaaaatccacattacaaaccctgtgctcaggaatgagactagagtgaagcacctaggatatgactctaaaagtgagtatctccttaaatttgtgtgccctaatttcttcactcaactgccctagtcctgaccctgcttgtattaaagccacacataatgtgccctgtatcctcaaatacatgatatgcctttatatctctgtatctttgcaatgttttttgccttcaccaccccctcctctctcatcattaaaaacaattcataattttaaactttatttgtttattagtgtcacgcctaagtagagtataagccccaagagaataggagtcatgtctatgttgctcactgttgtatctctagcaattaggaaaaggaagaaataaattaattcaattcaaagccacttcctctatggaaccctccctgactcttctctccctctgaaaattcagttgcttttctttttgtgcttacacaaggctccatggatataacacacttacagctttatgacattgtgtgatatttactagaagtatttatccccaactataaatatatatttaagtaaacatttctattttagaacaattttagatttacagaattattacaaagatagtacagagagtttctatatatgccacactagtttccctttcattaacatcttacactagtatgcatacttttcacagttaatgaaacaatattgatagattattattaactaaagtctgtattcaaatttcctcagttttcccttaatgttctttttttaattcatcaatgttccatccaggatatcacattacattcagtcactgcacctcctgcagctcccttggatttttcaaactttccttgtttttgatgaccttaacatattttagggttacaggtcagacattttataaaatatatttaaattttcaatgatgtttttctcatgatcagattggggtaacgtgtttttgaaaggaagacctcggaaataaagtgccattctcaccactttgtatcaaaggtataccaacaatatatattaatcttcatcacttggcttgaggtaatctttgtcaagtttcctcaccataaagttattatttttttctcccattccatgctttactctttggaagaaggtcactcttaagtaacaggggtttttatttcacctccttaagcgtggaatatttacataaattatttgaaattcttctgtatctgggacctattcttccccatttatttattcaataatttatttatattggcacaaactcaaggatatttgttttatatttggggctataagaatattttacttattttgttgctcaaatattccagctttggtcactgagaactatttcagttggctcctgtattccttttacatagcccccccttttttttttagcgcttttattgtttctggtactctaagatactccaagatcattttgtataattcatgctccagtgattgccagatattttctctaaaaagtcctggtttcttttattggagaatggtagtagaaacaaagatcagggtgccaggtgtgttcattgattgtgtcattgcttcttggccgtctcagctgacagagcaaggagatctaagtgtgatactgaacccatgtgtatagacatatgtataaatatttctctatgtaaccacctgcatcagtattaagctaaatgagagttgctagtgatgtctcttattctagtcctcaccacatggatcattctagcctccttcccttgcttatctgtaaacttccactcccacagtgagaaacctggctcctaccattcactatttgtttacttaattcttcaattccagtgtaactgtatagcagtgtgagaattgttaactcatactcccatgggaaccacctttatcactggagcagaatgcttctgaacagttccttttgcctttagtcttacagagttcacgcatttccaaaggtactcagatcagcaccttattccccctgcccacttcaattaggttgtttaatacgcttataatgcatttagatcttattgttattctgcattccatcctgggattccctggctgtctaaatatttttaatttgcatacattaagtttattctttgtgttctaaatttctataggttttgacaatgcttaatatcttgtattcaccattacaatatcataaagaataaatttaccgacctagaaattccactgtactttacccattcaaccctccttccctcaaaacactgtaacctctgaccttttcactctctctagttttgcctttacctgaatgtcacataagtgaaatcatgtaatatgtatccttttcagactgacttcttgcacttagcaataggtatctaatacttattcatgtctttttgtgactttatagctcttttgaaattacttttaaaaatcacaattttattgtgtggatgtatcagtttgtttattcattcacacattgaagggcatcttgattgctttcaatttttggtggttatgaataaagcaactacgaacattcatgtgtacatttttgtgtggacatagcttttcaaatcagttgggtaaatacctagaagcatgactgctgcactatatagtgaggttttgtttagctttgtaagaaactgccaaactgtcttccaaagaggctgtaccatttttcattctcacctgcagtgaacgagaggttttgtactgtttacttgccagcagttggtattgtcaattgtttggattctagccaatctaatacatgtaaagtggtatttcattgttgtttgaatttgcaacgctctaatgacaagtggtgttaacatcttatatgcttatttgccatctgtgtatcttctttgttaagttgtctattcacatcttttgtatatttccccctgctatattatttaatgttttaatgaaacatcacatacatgcatatgcagaagaaatcacaagtggccactatttgaacttctatatcataaacatacccatgtaacaagcgtctgagatcaagaaaaagaagatcactgacaccccagaaactcccctgtgtatcctcacatttattgccccttggcatctaacagaataaatttttcctatgttttaaactttattatgaatgggttatgcagtctatatttctttctttttacttctttcaatcaacattatgtttgaagatacatcaatattgttacatgtagttttagtttgttcatactcattgctatatggtattcctttatataaatttattgatcaattctacacaaatatttgtgtagtttgaagctattataaagagtactactatgaatattcttgtacatttctgttggtgcacatatatacatatttctatttggtgtatatctaggaaggaattgttagattacagagtaggcagatatgcagctttagtagatactgctgaacaatagttcagaatggttttatgaatttacacttccactagtgtaaaagagttctagtttctccacatccttgaaaacacttagtattgtcaggctttttaattttaggcaatttggtgggtgttttcttattatggttttaacttttatttttctgataactaataaagctactcatcttttcatgtgtttattgaacagttggatatactctgttgtgaaatgtctcttttggacctgaaagcatgtgttagtgaggctacagaaaagggactgtgacaggaaacacctagtgtgattttaaaagcaggaaataaaaagatgcatgtagttagcaaaacattaaagaatttatctaaatagctagagaggttcattgcagccagaagcggttcctttatttctataagacattccaaaacctgataggataatttctcaaaaaaaactttgaggaaggaagatgcaaggtagaccaagcattgagccatgcaccttgtgtgttttcttcattcttacaacaaatcaaggaggtagcaatttacagaccctagttttattctctctataatctgctgtgctaaaaagtgtcttgcgcaccaattgtcacagcagacttaagaaaataatctaaacattaaataaaccctacgtaaaaaaaaaagtctctttcaatcttttgcccatttttctatttgatggttgcattttcttactgatctgaacttcatatgttcttgatataattcttttgttgaatataggtaatgcaaatattttctccaacctatggattgacttttcactttcttaatagtatcttctcacaaatggaagttattacttttaatataatctaatttatcaaaattgtatcttatgattagcattttttgtgttctgttttaaaaatacctttggaaatcataattctcagtaaactatcgcaagaacaaaaaaccaaacactgcatgttctcactcataggtgggaattgaacaatgagaacacatggacacaggaaggggaacatcacactctggggactgttgtggggtagcgggaggggggagggatagctttaggagatatacctaatgctagatgacgagttaatgggtgcagcacaccagcatggcacatgtatacatatgtaactaacctgcacattgtgcacatgtaccttaaaacttaaagtataataaaataaaataaaataaaataataaaaaaatgcaaaaaaaaaatacctttgccaaccacaagatcatgaagaattctctaatgatttcctctaaaaactgtactgtttggctttttatatgatatgagaaatgggtcaatattcatttctaatagattgagagacaattggcacaaccacatttattgaaaagacactttctccactatattgcaatgtcaccattgtcctaattagatgactttgtatgtatcagtctatttctagactctattctctttctttttttttttggtttcggttttttttttttattaactttaagttttagggtacatgtgcacattgtgcaggttagttacatatgtatacatgtgccatgctggtgcgctgcacccactaactcgtcatctagcattaggtatatctcccgatgctatccctcctcactccccccaccccacaacagtccccagagtgtgatattccccttcctgtgtccatgtgatctcattgttcaattcccacctatgagtgagaatatgcggtgtttggttttttgttcttgcaatagtttactgagaatgatgatttccaatttcatccatgtccctacaaaggacacgaattcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctctgggtatatacccagtaatgggatggctgggtcaaatggtattgctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattctttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaaactctttagtttaattagatcccatttgtcaattttgtcttttgttgccattgcttttggtgttttggacatgaagtccttgcccatgcctatgtcctgaatggtaatgcctaggttttcttctagggcttttatggttttacgtctaacgtttaagtgtttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagacatgtggcattatttctgagggctctgttctgttccattgatctatatctctgttttggtacaagtaccatgctgttttggttactgtaggcttgtagtatagtttgaagtcaggtagtgtgatgcctccagctttgttcttttggcttaggattgccttggcaatgcgggctcttttttggttccatatgaactttaaagtagttttttccaattctttgaagtcattggtagcttgatggggatggcattgaatctgtaaattaccttgggcagtatggccattttcacgatattgattcttcctacccatgagcatggaatgttcttccatttgtttgtatcttctttcatttccttgagcaatggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacttgattttgtatcctgagactttgctgaagttgcttatcagcttaaggacattttgggctgagacaatggggttttctagatatacaatcatgtcgtctgcaaagagggacaatttgacttcctcttttcctaattgaataccctttatttccttctcctgcctaattgccctggccagaacttccaacactatgttgaataggagtggtgagagagggcatccctgtcttgtgccagtttgcaaagggaatgcttccagtttttgcccattcagtatgatattggctgtgggtttgtcacagatagctcttattatttttaaatacgtcccatcaatacctaatttattgagagtttttagcatgaagggttgttgaattttgtcaaaggttttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcgttttgccagtattttattgaggatttttcatcaatgttcatcaaggataatggtcgaaaattctctttatttgttgtgtctcttcctggctttggtatcagaatgatgctggcctcataaaatgagttagggaggattccctctttttctattggttggaatagtttcagaaggagtggtaccagttcctccttgtacctctggtagaattcagctgtgaatccacctggtcctggactctttttggttggtaagctattgattattgccacaatttcagatcctgttattggcctattcagagattcaacttcttcctggtttagtcttgggagagtgtatgtgtcaaggaatttatccatttcttctagattttctagtttatttgcatagaggtgtttgtagtattctctgatggtagtttgtatttctgtgggatcgctggtgatatcccctttatcattttttattgtgtctatttgattcttctctctttttttctttattagtctcactagcggtctatcaattttgttgatcctttcaaaaaaccagctcctggattcattaattttttgaagggttttctgtgtctctatttccttcagttctgctctgattttagttatttcttgcgttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtatttgagcggttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaatgtatattctgttgaattggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctattcttgttgaattgatccctttaccattatgtaatggccttctttgtctcttttgatctttgttggttgaaagtctgttttatcagagactaggattgcaacccctgcctttttttgttttccattggcttggtagatcttcctccatccttttattttgagcctatgtgtgtctctgcacgtgagatgggtttcctgaatacagcacattgatgggtcttgactctatccaatttgccagtctgtgtcttttaattggaatatttagtccatttacatttaaagttaatattgttatgtgtgaatttgatcctgtcatgatgatgttagttggttattttgctcgttagttgatgtagtttcttcctagtctcgatggtctttacattttggcatgattttgccgcagctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggataggaaattctgggttgaaaattcttttctttaagaatgttgaatattggcccccactctcttctggcttgtagggtttctgccaagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacattggcctgccttgctagattggggaagttctcctggataatatcctgcagagtgttttccaacttggttccattctccccgtcactttcaggtacaccagtcagatgtagatttggtcttttcacatagtcccatatttcttggaggctttgctcatttctttttattctttttttctctaaacttcccttctcgcttcatttcgttcatttcatcttccatcgctgataccctttcttccagttgatcgcatcggctcctgaggcttctgcattcttcacgtagctctcgagccttggttttcagctccatcagctcctttaagcacttctctctattgattattctagttatacattcttctaaatttttttcaaagttttcaacttctttgcctttggtttaaatgtcctcctgtagctcagagtaatttgatcgtctgaagcctttttctctcagctcgtcaaagtcattctctgtccagctttgttccgttgctggtgaggaactgcgttcctttggaggaggagaggcgctctactttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggaataccctgccgtgtgaggtgtcagtgtgcccctggtggggggtgcctcccagttaggctgctcgggggtcaggggtcagggacccagttcaggaggcagtctgcccgttctcagatctccagctgcgtgctaggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccagctgctttgcttacctaatcaagcctgggcaatgtcgggcgcccctcccccagcctcgctgctgccttgcagtttgatctcagactgctgtgctagcaatcagtgagactccgtgggcgtaggaccctccgagccaggtgcgggacagactctcgtggtgcgcagttttttaagcccgtcggaaaagcgcagtattcaggtgggagtgacccgattttccaggtgcgtccgtcacccctttctttgactcggaaagggaactccctgaccccttgcacttcccaagtgaggcaatgcctcgccctgcttcggctcgcgcatggtgcacgcacccactgacctgcgcccactgtctggcactccctagtgagatgaacctggtacctcagatggaaatgcagaaatcacctgtcttctgcctcgctcacgctgggagctgtagaccggagctgttcctattctgccatcttgactcctcccccctgtattctctttcttggtgtatttatcaatcctggcacactatattaattattatacctttataataggccttaacatatggtagtgtaactgctttagctgctccaaataggttttgtgctcccaaatgtaggtctatattttgtttttctttcttttctcaggccccaactccgtgtctgacacaaagtcaggtctgagtaaataatctagccttctatttaccaccacacttttggagtgatttatatctacttcttttacttccttactacccacctctgccttagacagtgtcattcaacctctacatttccatgccaatagaatgctgttttccaagatcaccatttgtggtgaacaatgttagtgcttcaactagatctactcagatctttctttgtgtcttctgtgatttgggtgagcatttgttccagcaataagcacttgcgtttcttttgcaggtgactgttcttggatctcagaacccctttatccacctgcatggagagccagaagtgccaggacatttaggtccctcttggatcttaaacaatgaataatgaatgagggaatatgaaagtcccagatctcttgcctcacaccagaacaactctgggacacaatatactccaaagttcccctgtggaatcagactgtagctacatttgggggactttgtctattatcatgcccttgcttgacttctgctccatccttgtcttgcttccccaatctcctgtcagttctctttgggggcactacctagtatatgatttgcatgtgtctgagggcctgcttctgaggaaactttcctaggatagttgaccaaaaatgatcctagaagcggactctaacgatgtaattctggaattgtatcagttgtcagctacagtgcaacagtgatttcttgctgcattataattgctaaactttcatctgttgttagttggaatggattcaaatgtagaagaagatgctgtgccctatgtgatatctgtagcattttgagacatagcagggaaatggactgtggaatttgttgtttctgggcaacactgatgtgttgaagggaggaaatgacagcctcaagtcagccaattaccaacttaatccactgtgtacaacttagaagacctccatagcagcgtataaagagaccctcctcctgcattgagaatggaaaccatactgaagacctgattttttaattattattatactttaagttctgggatacatgtgtagaatgtgcaggtcttatgtttaagtctataatccatgttaagttaatttttgtataaggtataaggaagaggttcagtttcagttttctgcatatagctagccagttttcccaacaccatttattaaatagggaatcctttccccattgcttgtttttgtcacgtttgtcaaagatcagatggttgtagatgtgtggcattatttctgaggcctctgttctgttccattcatctatatatctgttttggtaccagtaccctgcttttttggttacttgtagcctatagaaatcaggtagcatgatgcctccagctttgttctttttgcttaggattgtcttggctatacgggttcttttttggttccatatgaaatttaaagtagttttttctaattctgtgaagaaagtcaatgatagcttaatggggatagaattgaatctataaattactttgggcagtatggccattttcacaatattgattgttcctatccatgagcatggaatgtttttccatttatttgcgtcctcttttatttccttgagcagtggtttgtagttctccttgaagaggtctttcatatcccttgtgagttgtattcctaggtattttattctctttgtagcaattgtgaatgggagttcactcatgatttggctttctgtttgtctactattggtgtatagcagtgcctgtgatttttgcacattgattttgtatcctgagactttgctgaagttgcttatcagcttaaggagattttgggatgagatgatggggttttctaaatatataatcatgtcatctgcaaacagagacaatttgacttcctctcttcctatttgagtaccctttatttcttttgcttgcctgattgccctggccagaacttccaatactatgttgaataggagtggtgagagagggcatccttgtcttgtgccagttttcaaagggaatgcttccagcttttgcccattcaatatgatattggttgtgggtttgtcataaatagctcttattattttgagatacgttccatcaataactagcttattgagagttttagcatgaagaggtgttgaatgttatcgaaggccttttctgcatctattgagataatcatgtggtttttgtcattggttctgtttatgtgatggattatgtttattgatttgtgtatgttgaaccagccttgcatcccagggatgcagccaacttcatcgtggtggataagctttttgatgtgcactggattcagtttgctagtattttattgaggattttcacatctgtgtttatcagggatactggcctgaaattttctttttttgttgtgtctatgccaggttttgatatcagcatgatgctggcctcataaaatgagttagggaggagtccctctttttctattgtttggattagtttcataaggaatttgtctttgtacctctggtagaattcggctgtgaatccatctggtcctgggctttttttggttggtaggctattaattactgcttcaatttcagaacttgttattggtctattcagggatttgattcgacttctttctggcttagtcttgggagggtgtatgtgtccaggaatttatccatttcttctagattttccagtttatttgagtagaggtgtttatactattctccgatggtagtttgtatttctgtgggatcagtggtgatatcccctttatcattttttattgtgtctgtgtgattcttctctcttttcttctttattagtcttgctagcagtctatctattttgttgatcttttcaaaaaaccagctcctggattcattgagttttgaaaggttttttgtgtctctatctccttcagttctgctccaattttagttatttcttgtcttctgctagcttttgaatgtgtttgctcctgcttctctagttcttttaattgtgatgttagggtgtcaattttagatttttcctctttctcttgtgggcattcagtgctatcaatttccctctaaacactgctttagctgtgtcccagagattctggtacattgtgtctttgttctcattggtttcaaataactcatttattcctgccttaattttgttatttacccagtagtcattcaggagcaggttgttcagtttccatgtagttgtgtggttttgagtgagttttcttaatcctgagttctaatttgattgcactgtggtctgagagactgtttgttatgatttctgttcttttgcatttgctaaggagtgttttccttccaattatgtggtcagttttagaataagtgtgatgtggtgctgaaaagaatgtatatgctgttgatttggggtggagagttctgtagatgtctattaagtccacttggtccaaagctgagttcaagtcctgaatatccttgttaatgttctgtcttgttgatctgtctaatattgacagtggggtgttaaagtctcccactattattgtttgggagtctgaatctctttgtaggtctctaagaacttgctttatgaatctggatgttcttgtattgggtgcatatatatttaggatagttagcttttcttgttgcgttgatccctttaccattatgtaatgcccttctttgccttttttgatctttgttgctttaaagcctgttttgtcagagactaggattgcaacccctgcttttttttgctttccatttgcatggtaaatgttgctcaatttcttaattttgagcctatgtatgtctttgcatgtgagatgggtctcctgaatacagcacgctgatgcgtcctgactctttatccaatttgccagtttgtgtcttttaattgtgacatttagcccatttacatttaaggttaatattgttactgttatgtgtgaatttgatcctgtcattatgatgctagctggttattttgcctgttagttgatgcagtttcttcatagtattgatggtctttacaatttggtatgtttttgcagtgaccggtactggtttttcctttccataattagtgcttccttcaggagctcttgtaaggcagggctactggtgacaaaatctctcagcatttgcttgtctgtaaaggattttatttccccttatgaagcttaatttggctggatatgaaattctgtgttgaaaattcttttctttaacaatgttgaatgtcggcctccactctcttctggcttgtatggtttctgccgagagatctgctgttagtctgatgggcttccctttgtgggtaacgagacctttctttctggctgcctttaacattttttccttcatttcaaccttggtgaatctgacgattatgtgtcttggggttgctcttctcgaggggtatatttgtggtgttctctgtatttcctgaatttgaatgttggcctgtcttgctaggttgggaagttttcctggataacatcctgaagagtgttttccaacttggttccattcaccctgtcactttcaggtacaccaatcaaatgtaggtttggtcttttcacatagtcccatatttcttgtaggctttgttcattcatttttattcttttttctctaatcttgtcttcacactttgtttcattaagttgatctttaatctgtgatatcctttcctccacttgatcaattcggctgttgatacttgtgtatgtttcatgaagttctcatgctgtgatttcagctccatcaggtcatttatgttcttctctaaactgtttattctagttagcaattcctctaaccttttttcaagatttttagcttccttgcattggattagtacatgctcctttagctcagaggagtttgttattacccaccttctgaaccctacttcttttaattcgtcaaactcattctctgtctagttttgtttccttgctggcgaggagttgtgatcctttggagaagaggcattctgatttttgaaaatttcagcctttttgtgcttgttttttctcatcttcgtggatttctcttcctttggtctttgatgttggtgaccttcagatgggatttctgtttgggcatcctttttgttgatgttgatgctattcctttctgtttgttagttttccttctaacagtcaggcccctctgctgcaggtctgctggagtttgctggaggtccactccagacactgtttgcctgagtattaccagcagaggctgcagaactgcaaaaattgctgtctcttccttcctctggaagctttgtcccacaggggcacccgccagatgccagcctgagctctcctgtatgaggtgtctgtcaacccctgctgggaagtgtctcccagtcaggatgcacgggggtcagggactcacttgaggaggcagtctgtcccttagcagagctcaaacgctgtgctgggtgttccgctgctctcttcagagccagcaggcaggaacatttaagtctgctgaagctgtgcccacagctgccccttcccccaggtgctctgtcccagggagatgggagttttgtctataagcccctgactggggctgctgtctttctttcagagataccctgcccagagaggagaaatctagagaggcagtctgactacagtggcgttgcccagctgcggtgggctccgcccagtttgaacttcttggtggctttgtttacactgtgaggggaaaatcgcctactcaagtctcagtaatggtggatgtccttccccccaccaagctcgagtgtctctggtcaacttcagactgctgtactggcagcaagaattttgagccagtggatcttagcttgctgggctccttgggggtaggatctgttgagctagaccatttggctccctggcttcagccccctttgcaggggagtgaacagttatctcgctggcgttacaggtgccactggggtataaaaaacagcaaacaaacaaaaaaactcctgcagctagcttggtgtctgcccaaacagctgcccagttttatgcttgaaatcctgggccatggtggcgtaggcacctgagggaatctcctgatctgcaggttgtgaagaccatgggaaaagcatagcatctgggctggaatgcaccattcctcagggcacagtcccttatggttttccttggctaggggaaggagttccccgaccccttgtgcttcctgagtgaggtgacgcaccaccctgctttggctagctctccatgggctgcacccactgtctaaccagtcccaatgagaagagccaggtacctcagttggaaatgcagaaatcacccgccttttgcgttgatctcgctgtgaactgcagaccggagccgttcctattcggccatcttgccagccaccctgaagacctgatttttaaaagtagaagagtgtcagagaaggtgaaattcatagcctccataagactaagacccgtacacaaaaattatggctctgacagggaatgactcacaatctgaggcttgggttggggtcacctaagtttacccactgacgaaatatggaacctttttattctccaaaacattgtggtcctgcaataaatagtccattccttattgctagtagataacagcactctcctgtctgaaggctaagtagagattttaactgaagtagatgccttgcaagccaatacttgcccttctcaagatctaccccaacatttctttctggccattggaccaataactaggtcaagttagcgtgaccaatctggggaaggtctggctttactaatggaggaaatgtgttattaatcaaaggagctacagaatctaataatatgtgttatcaggaactggggtaacatgcctgcatatgtatcttgaagctaacttgattaaagaaaagtgaaatataaagctggataagagaaaacacttttaaaatttgttttctatatgtgagcattctactgtgactcaatatttaacatatcttgtaagggtacctggagccaagcctattagttaaaatgactgagatgactcctggaaatttgggggaaaatgtgaatcgcattaaatgaaatgagatgcttgaactgctttgtcagagtgttaaaaaatggggataaaaatgctctcagaagtgggcatgttagaatggatctatttcataaaacctgaggtcccaccagaggactatttttgggaaggctcagagtacactcccttgactaaggtgaaaagaagtgcaataataaggggcagttccaaaatattttagaagctcagaagtaaatgatctctgctctgctaggctggagctgactgtaggagattaggttatagaattgagctttctagtttctgtggaaatgataagattccagaagaacagaggtcagatggcagcacacaatcgccagaagccaggtgaacacaattattgtaatggtcaagtggcaaccaaagtgtcctgtcatgcaggaatgtatggtgatgactaatagatcatggtgttcctagaagcaagatacacagttggccaatgagagtgttgtttgcttgacatatataatttataatcataagtggatgaatagaagttaatctacactaccccaatgaagggtcaaaatattttgccttgttttcatgcctgagccagttgttagcctcagaagtcatcaatcgaaagagaaattgagtacgcttgaagaaagatcttgcaatgcaaaagcaagcatatacagtagtgattctatcagttcttccccaaaagggacttattaacatttataaatataagcgaacactaagaaaaaggggattgcccatatcttttaagggctgttggatacagagtttaagcagatgctgatattaaggaacctaaagcacaataacacccacccccaacactaaaataggtccttgtggaattcagttcttgccttggtccatcttacagtgggtccaatgggtccaaagactcagtgggaatttctgattgcttaagcagaaggacatacttagcatgtggaagaaacctgacttttggttccaggacccatgaattaagagctattatggtagaaaatcacacatgaacattatgaaagtggtaccttccccagaacaaggtggtaaataaaaaacgataccacattttaagtggaatggtagagattagtgacaatcccaaagacttaagggagcagggctgataatccacattatgtcttcattcactgtgaaaaaaatagatgtaccatggtagattatgatgaactaacacaaacttaaacaagtaatagtcctgactaaagcttgtatgccagatatggtttttttactataatggattattatcaatgcagcatctggtatttggtaggtggatttgatggggctaaaagatttgtttaaatcttcatctggaaagaggaggagaagttgttcatattcacccaaataggcagtagtatacctttatgcttttgattcaggtctattttaactctcctgccatttgttataatacagtacaaagagaatacgatcgtctgaaaattctataggatatcatgatggtccactatattgataacatcaatttaattggctctgataaagagaaagtggcaagtactctggattcgcgagctccagagggtagaaaataaaccttataaggatgcagagatttgtcacattggtgaaattttgcaggattcacttacgtttctttgaatggcaaaaaatgacaattacttttgcaccaacataatatttaggtcatgccagtatgtcctttccatgaaaagggcactttattacaccttgactctcctactattgagaacatagcacagtgctttgtaggtctttttggattttggagactgcatatactgcaattgggaatactagcttgactcatttttgagattactttgaaatcttccagttttaattggggttataaacaagaaagggcattgaggaatatccaggctatagtacaaatggcatgactgcttgagataaacaacctggcaaatttcatggagctgaggatatttgcagtagatacagatgccagatggagtcttgggtgaatcccaacagaagagttgaggcataaatccctagggttttgaagcaagtcatattttctgcagcaaagaaagggacacacttcaaaaagaagctccagatatgctattaggtcctggtagagaatgagtgagtgtccatgggacatcaattgactatgcattcagagcttgtatataaactgggttctgtcagacacacgaggtcataagttggtcaatcacagcagcaattcatggtatatttggaattagatctgactatgtccagtgggtatgagtgagttacatgaaccagtggcccagttctcattgttgcaataaggcctatctctttctcagctcacacctatgggttcatgggggcattctctatgacgagttgacagaggcagctaaactacatcctcactcagaggtaactctaaaaatgcagtagtaattgaagtttttcaagtatgcaaagctggtcaatcatccactctgggtgaagacataaatggctcttgttagtcatacatgaacttctggacagtggtaaatagtttgtctgattgggcaaggtcttaggagaagcaggattgaatgattaaggcaaagaagaggcatacagttaaacctataggagttggcaccaaatgtgaggatctttacatctcacagtaatgcccatgaaagatcatccacaaaacgaaaagtactaaacaatgggtcaacagaattattcgttcagtagatgtcagcatctgtgtttgtcatacaagcacttacatgatatacctatgaatgtagtaatcatggtatgcgagacagaggctatgtattggactaacatttgggcttcctttcaccaaagctgattagctactatcacttagtatctttaataaatatctttttgatctttcagcactggagactaatgcttaatcttcaatatggtactgtttctcaaagagaaaaaccaactacttgatggaaagttgattttatcttgcttcagaagggacaatgatttatcagaacttcgatttacttgtattctgggtgtggatttgtcttttctacctgcagtgcttcaacccactctactatctatattcttatagaaaatctgacttactgacatgaggttcgatataatattatctcacattaattgattcactttatatcaaagcagtcataacaataattttataaccatgggatccacttgttctacaatataccgcatacccagaagctgccagccttagtggagtactgacatggtctcttaaaggcacatataaagcagtatcttggaaatgatgcctgtgatttgagggctttgttcttcatgaggcaatgtatgtcttaaaccagcagtcattatatgacactctaccataaataggtagaatacacagacctggcagaaaatgagtggacattggagtgaccccattcaccatcattcccagggactcatttgaaaactttaagttctgtggttctagatgtcctggtttccagaaagtagatgcttccgctagggaacactataagattcctactaaacttaaagttatggctgccacctggtaatttgaggtttcttgtgccactggagcagcaggtaaagaaaggagttaacatactggcaaggctaattggccttgatcataatgagcagatagagttgtttctcccatatacatttttaactgtgaatggacaatggccctgggaggaaggggctggagaacaggaaagtcagtcatctttctgccatgtacagccttccaggcatcttgagcaccttaagactgattctacctccacagcaatgagctcagaacatagcaagaagggaagacatttccaaggtgacccaggcccaaacatcacctccacaaggcatcagcatgaagcattcccaatcatgatgaggcccgaggattggctccactctcaggaaaagaaggaaatgtatttattaactataggccaagagggaatatggcaacagggatctgaatgtcaggaaatgatgccctaggtggaattggattacttattcaaaagctaaatcaaaaaagttgttcagtgctggctgaaagggtaattctgggacttgtgaggatttgactccatcagccagagatgggataaacttgctatatcagagggcctatccaaggatctatttggcatatttttatttctatgcccgatcatatgacactgagtacccctcacattatcctacacttattcaaagtttcttatttgctgagtgtccacagtgttccaggcactgtgccaaattcaagtagtggtgggactgagagagtggcactgggtgctgggataagatacacagttgaattagccagggtaccttcccttgaatagactgagtgagatctagcagggcagacagaatattgatcgaaaatagtatgaaaagtgataatacacaagtctaaacacaatgccatgagactccaagggaagaataagttgttcagctgtctgaaagtcaaggaagtattcacaaaggagaagacacttgagtgaaggtttaattgataagtagaagtttgataggctgagcagaggaggaaagtcattctgggcagagggaataaaggcacaaaaataagaaaatagccagatttctgtgaaatggtgaggagcctttgtggggatgagatccattacaaacagttgcgcaagtttttctctgtataagggtgcctggctaaaagatccccccttgcattctgcttgatacatcagacattctgatgaggagctttaagctgtgtcttcctaaagaaagggtcttattctacaaactgttgttatcagaggtccacaattttccttttgtcttggagtttcatcccagggtactatagagaatgatcccctcaagatattctcagccccaaatcagataccagtggcagatttttcttgtgaatctctgccaggtcctagagttgatggctcttacttcatgctagaaaccctgagacattcgggggaaggaaaaactggagatggcctcttccagaggctccttgtggctttggagaacatggtgcccaagaagttcagtgattcaggggagccaaggaaggggcaggagagaggcaattggtagctaatgcaaagaagaataactccaaccatgggccacaaatacatttaatatatagttagactcaactaacaatacctatttcctcccaccaccaagtacaaacacacacacacgcatgcacacacacacattctcctacattctcctaaggaagaaaaggaaaaggaggcagaactataagctgatgccctatcacccaataacctaaagctgtgagtcagaaaataagccatagtaggaatataaaactccttcttgctttccctcacccattctaacactttcctcaagtttttagcagatttgccctagcagtaccagggctggctgccagacatcaaagcttcatgtgtccactgtagctattgcccactccactccagatgtcacaacttgttattgatattttaccaccaatactcccaacttggaggcaagatgactttgtgcctctttacatctttgtagagactcctcagcactccatatcccaatttctgtgaccttgatcagtttgcttgtcagcacgaagtctgtttcttcatctcttaaacagtaaagatgataatatctatctcagtgggttgtttgtaaggattaaatgagatgttttgggcaaggcacccaacacagtgtgtctggcacatagtacaaacccactaaatattattaattagtgtctatccaacacaggtgcagttcagttacacagttaataaaagactcaatgggggcttgaaccaaagttttatgatttggtcaaatttattagtttatggatctatccacttatcctggaagggaactttggggtttttccagtttactttctgagtgtctactctgtgtaagtaactagggctcggcactggaaataccaagatgaacaagatattattcctgcttttgagaagttgatagtctcatcggggagaatggtgaccaaatagttacaatgcaaagaggtagtcctgttatagttggatgcaggattctgtggaagcacaaatcagaggcaattggttcaaagtaggaataaagggaaaaatttcttcatgagatgtcacctgaggtgagttttggcagatgagtgggtgttggtgttatgaaaaggagaggcatgggtgtgttgctgataagagttatgggtgggagtccacatccaggctatggtgcctaagcaagatcctagtgtccagggtaccttagggctgaagcacgagggatagggaagaagctagagagtttggcaggaaccaagtcacgagagtttgtagactctagattatgggacttttttttcctgagagtaatagggacaattgactgattttaaaatggacaatgatatatttggatgtgatgttttaaaaggactagggcaggcacatcagataagagatacttgcagtagttgaggctagagatgaagttggcttacaccagagtagtagtagtggagatggaggatatatatgtgatgggagatatatttgggggatacagaatggacaggacatgataggactcattgatggatgaagggtgagggcaaaaaccaaaatccagggttactgtaaggattttggcctaaggaactgggtaaatgatggtggcagccagtaagactaggaacatggaagaaattttttcctactctctcattttgcatgtaagaaaactgagtccctcagaggagaagcagtatgcccaaggttgcacaaaatagtagaaacaagttgggggtgtgggacacagatttcatttttatttagtttttgtccaacacattttacactgccccaaaatgttcctcagctcagcagtctttgtacattggtaagagataaatgaatcaaattaacatcagaagctcagtatcaaagcagggagggtagatgcttaggtaataaatctacagttttgttaacatgactcccattaaagagaatttattcaccaggcattgatttttttcttttagcattggacttacaatgagtgatttcatatttagcaaaacacactactcttggtaattaatgagacaagaatcacagcccagtcaggaggatatgtggtttccaacaacgatgtaaggcctggttgaaaaaggagagatagcttttatactctaaggagtctcagtcttcagcaacccccagtctggagaaggaaatagctattcatccaagttatatctattgagggccccactgtgttccaggcactgttctaagcatttgggatatgttgatgagctaaatagacataggtagctgatttaattgagcttacattttagtgaaggagaaagacaataaacagtaaatgccatatgtaagtaaaacatatagtatgtttgataaagataaatgctaaggaaaaatatgaaatgaaaaatataagcatgtgttacgaattgaattgtgtccctcaaaaattcatatgttgaagtcccaatttcccgtacttcagattgtgactatatatggagataaaggcttcaaaaattaatttaaagggaggtcattgggggcaggcctaatccaatatgactggtgtccttataagtaaagagaatttgaacatgaacatgtacacaagaagaccatatgaaaacacagggagaggacagtcatctacaatccaaggagagaggtctcagaaaaaaccaacctatttgatatcaaactttcagtctccagaactgtgagaaaataaactttcatagtcttagctgcatagtttgtaacactttgttatggcagtcctagcaaactaacatgagagggggataaggagtgctggggtggcactagggtttcagttttgcctagaaagataaggtgaaatatgagcaaaaaacatggaggaaatgaaggagcatcacagagagatatctggggaagtgtgtctgaggcagaggagagagcaagtacaaaggtcctgaggtgggagtgtgcctggtgagttttacgaacagcaaagaaagccagcatggctaaagcagagtgattaagggggaaattgggaggagatgaggtcacaaagttaatatatgatgggccagatcatgtagggccttttaggttattgtatgaaagtttactctcggtgaaattaagatcaagccactatggaaaacagtttgttggttcctcagtgaattaaagatacacttaccatatgacccagaaattctactcttaggtatatacgcaaaagaactgaaaatagatgcttgtacgtggatgctcatagcagcataatttacagtagccaaaaggtagaaacaactcaaacgtctaacaaaagataactggataaataaaatgtagtatatccatacaatggaatattatttcaccataaaaagaaatgaagttaattcctgtacattgtaggactgctacaatatggataaaccttgaaaatatcatactaaatgaaaggaaccagtcacaaaaggctacatatcatgtagttccatttatatgaaatgtttagaataggcaaatccatggaggcagaaagattagtgaatgtcaggttctgggtagaatggggaatggggagtgattgcttaatgggaatcgattttccttttagggcaatgaaaatgttctggaactagatggtggtgatgatgacataacattgtgaatttactaaaattcaccaatggtaaattttatgttacatatattttaccatgtattaattagtcaggattctccagaggaaaaaaccacctagagagagagtgagagtagaaattggctcactcaattgtggagactggaagtctcataatctaccacctgcaagctggagaaccaggaaagtcagtgatgcaagtcagtctgagtctgaaggcctgagaactaggagcactgatgtctgagggcaggagaagatggatgtcccagatcaaacaggaagtaaattcacacttactttgcctttttgttccagtcaggctttcaatggattggatgagcccactgtattggtgaaagtgatctctattcagtctatcagttcaaatgtcaatctctcctggaaacaccatcatagacgcacccagaaataatgtttgacaaactatctgggcatcccttagccaaatcaagttgatacacaaaattaaccatcacataccacagtaaaaatatttatatccaaagtactgttttgaacagaggagtataatgatttggcctatgtattttttaataaaagatcatttacctgctctgttaagaaggaacttataggcaacaacagaagcagggctatcaatcagaggctgtttcaacataaaattgaaagttgtgacttagaatggtagtagtggagatggtgagaaatgattgtatactgggaatatactgaacatagagacagcagtttttcctaacagattagatgtggatgtgagagaaaaagaagagtcaaggatgactttaaggttttgacttgaccaagtggaagaataaagttgccatcaactgaagaaggggcacttttgaagagaaagatcaggaggtgtttgtttgcttgttttttgatggacatgtcaagtttgaaatttctattagacatctaaatgtatatgttgattaaataagtggatgaagagttctggaacttagtggaaaggtctgggaaggagatactagtttggaagttttcagcatgtagatatttaaagccatgagacttgatgagattataagtgatggttctcccatcctatataggctgttcagactctcacattgtggaaccttaattctgatagaggaaacataatttctttactctaaaaagctctcaatttttaggaagatatggtcaacaggttccttgtctgcacagagaaatttttggtaccctgatatgtccccagcatgacagaaaaatcattgtctccttactctaaagatctcccaattttattagggagacattgtccacctactctaagtaaccccaaggttgagaagaaagacattctttctcagtagggaacctccccaagcctgatgaagaaagcgtggcctctgctccagtctccctagggtttataccagctgccccaagaaggaggcatataaagcactagcatagctcaggcagaagcaacagctcacagacctaaagctaacaatgaagaaatccatacatgttacagcccaaagctgaataccagctaatgtctatgtctgggaagagcagttagagttcattaattgagttgctggtaacactgccattctcaaggctaattatccttaattggagttgtctactttgataataagcatttagtttccttccattcaatttaacaatattccaggcactatgctagacactttggagaataccatactttaaagagctcaatgtttaggcatgagatcagcctgatatgtagataactcaaacttaaggcagaaggtaatgagtgcagtagagaattatatgcactagcatatagtgttagagcagagattaattctgcctgggagtggggggagttggatggagttgtatagaagaaacaatatttgagctagaatttaggagaatggagtaaaatttccatgggtaggagaaaggcattccaggcagaggaaacatcagcaagtgattgaaagcctacaaatgcagagcataaataattatctatgtactcacttgtttatttcatttatccattaatttagcaaatatttattgagcacctattatgtcccaggcatcctcctaggtgctttagatataacagtgaacaaatcaaattccctgtactcagggagtttatattctagaggactgggatggattataaacaaagaaacaaacaaatatgtaatttgttaggtagtaataaatgctttgaagaaaaataaagcataataaggggtagagtgtgatggggaagaggttctgtcattttatatagagtgatcagggaagtcatctctgctaaggtgccagttgaatagagacttgaatgagatgaaggagtgcataaaatacatatccaatggaagaacattttattaaatagatggggaaaatagcaagtggaaataccttgtggcaagagtatgttttctatgttctaaggatcaagacctgagcaacaagaagactaaaatcaccatttaccaaaattgggaagcctgagatagaggcagccttggaatttatggaggatctggagtttggtttggagtatattaggtttaacatgtttattagatatccaggtgtaggtaaccaataggcaattggatatatgaatctgtagtttaggagagatatccagtctggagctaaaaactggggagctgatggctcatcaattatatttaacatcatgaaactggatgagatcgtaaaggagcaactgaagatagagtcatggtctaaggactgagctccaaggtactctaacgttaagcatttggatcaatgatcagaagccaatgaaagagatttgaaataaatcatgagtagagaggttttccaaagtgaaagcaagaagtaacaaggctcagaattacagcctggcattggggatatagaaatgggctaaggatcgggtgtggagggcaccaggttggggacgtgtaaaggagagagaaggtcatgggaggcctcatgggtattattttggctcacagaacttggtagataatggtgccattagctaatacaggggatatgagcagaaaagaactagcttgagcagaggaaataagaggagttggggaaatgttgagttcagtttgtgatatttgagtttgagatttttgtaaggcattcaagaagagaaatcagattgacatttgtaaatgcaagatctctagaacataaaaactggcattgtttcttcagccactaaccactgtgtgtttgtcactcaatttcataacatggtgtccactgatgagtgagggctggaggagagacatacttagtaaggaggagattcaaatttctgaatctactctgccacacactagatgtgagaccttgggacagtcatgtcatctctctgagcctaggtttcctcattggtaaatggagacaatattaatacctcatgggttgttttggggattaaatgagataatgcatggaaaaaatcttgagagaagtaagtgcatacaaaattttggttgagtgaaactatgaataaaacaatagtttgagcacctcccaggggaaccaggaaattccagatggggaggtgcaagtcagacaaggcatatctgggacataagtgggaagtgggagtagaaaggacctttctggaagttcctggtgtttccctagagactctagaagtttaagaggtggccttcaggaagggctactgggaagtcacctgcttgtctgggcttcgggcagacctgcccttgagatgtctgtgccaattcctccaggaggggagctgtctctggggactaggtggggctcagaaaagggataagaggccagaaactgagggcttgtgggctgagcagatctgaagtgggttagtcattgactgggctggggcagatggagatacagaaaaagggaaaggataaaaggagtataacatcacagcaataatgtaagaaacagtgcatgtgtatgtgatggggtgaagaggttgagtgacagagactggaaatagaatgagaaagcaatcagcactacagcagtgcctgtcagagcctagcagagggcctgacactcaattggtaggcagtatttgttgaatgaatgtatgaatggagcagggggcaggctgggaggagagagagagagagagagagagagagagagagagagagagaatgatatgagtggtggaagactggatctgtaactcgacaaacattattgatcccctatcgcctgccaggtactgagaaaataacaggctgaagcacagcactgagtcacaaatagcttcaggccataacaggctggcgactgtgtagaaagcaatatggaaagcagtcactgttctcagttgtctgaagtgtctgagtgtccaccagaaaatccttaccctgcctgcttctgtggtgatttagtgtccctgtacctactgtatgtcaaactccaggaaaatcagcaagcctgttttaatatcagttatcagtacattaaactgggaagaaaactcatttggaatgccaagaactgtcacctgatttatgtcttttgattcttaccagaattctgaaaggtaggcatcatgaatcattcccattttcgatatgacaaacctgaggcttataagtagaatggcttgctcaagatcatagcagaaccaggattcaaacctagttctcctattcattggtctgttttctgttctctcatccctggctgcattcatgaatcctgtacacatccagccccagcactgcctcccaaagactggataaatggaaacacacatatctgaagtcagcatatgttgaacagaagcatatgctgcacaggaagaatcttggctttagtatagattttacatcagggactctaatataaaaaggatcccagtgcaattcattcatacattcattactcattcactcatttaatcacatatattcatatatactttgaacataggctggtctcatgctatgtgtcccaagtagttgtaagtataaacagaagtcagaaatggtgagttacatagagaagttctctctattaagtgatgggaaaattaaagagaacaatgataatagctaacgtttattgcatgcttacactgttccaactacttcccgtggtttaacttcttatatcttcaaaaataactgtataaggtataggtaccattattttctccattttatggttggagaatggagacccagagaaattatacagcttgcctaaggtgacacagccagttaagtggcagagccaggatttgaatccaggaagtctggctccagagttcccaaaatgacaattcctggctgggataagtgctatgttttctatcctctcttctcaatcatcctgacattccttctctgctcaaaggagatctctctccctttttgtatcattctctttgccagtccatgcttctgtttcttctgttaccctcacctagagtgaccctccactgctttatcctcctatccaagtctctgaattcttatgctgaaaatatcacttccaatgttgtcaacttcttcctgaagcttcacatgaacccaccttatcaatgtgaagtgaattctttctctttctctgtagagtaagtatgtagcacttactatattctgctgatatttttgtttttatattattacttgtatacttatatttccttcctctccccactgccaactagattgcatcttccttaagagctaggaccatgtcttgagtcctgaaagtgtttggcgtggtgctgaggggttgtaggtgtctgtttgtacagaagtgaattatctgatgcttggtttcccagatatacatgagcttcatgcaatatgtcttggtgtatgagtcaaaatcacctgcttcctaaagggacttttcacatctttgatgcaagttgtagaggtggtgtggagcataggtttgatgatgccatagaagacaacaatgaatttgtttataccttggaaaacctgtgaatgagattttaataggctgcaaaaggacctggggaagaacagcagataacacaaatgcagtgacctcagttgaaatcccatggtgtcagtatccttagaatagcccataatacttccagagggagaagggatgtttggctggggactttctagtgcttttgtcatttcataactatgttgacattaaaaaacaaatttcacctgaaattccccaatagagctgggatgaggcaggacatatataatggtttccttggaaaatattggttatatagaagatagggaattcttacttctgaacactgggaatcaccttccagcagatagtttcaaaaatgggggtgtgggaggtgagagactttcctcccaagccatcaaggaaagaaaaaaaaaatactgcttcagaaatttgggcactatttgaagaaaggagctatcttcccatgtttgccaccaaaaactttgcactagtctgacttagacttgaggaactatagttctatctgaatgcagaatgtagaggaaaagctgcctcttcattgaaccaatgaaaaactggatattggtcatgttccaggactctaaaccacgcctgctgccacttttaccctttgcagctgattaaatcaactgcctaggacccaccttgagccattgtctgctgggtttctacatctttgatggaggtaaatgcttctacatgagtttatctcaggctctaaagagcaaagattggtgagcagagactaatctgttcaaattctctcgactacctgaggctaggttatctgggggatctggcttccaaaggagaaattagaacgtaataggaacctctgtgcaaaacatgtggagtgactgagggaagctaacgtaaaggttaaaaattccttcctgtttctcttccttctgctatttaactccctgcagcctgtagcctcgcaaactggtggatacccagtttacttattttttgtgatgcagagctcattaacatacacatgtggtacatgtcggaaaagctctagctgtttcttattactctatggagccacgcagaataagtttgaactttcttcaaaatgacaacttttcaaatattcaagatagctcttattgtccttcatcacctaacaccctgattattcaatatcccccaacagatctaccaaatctctgcccttctttctaatctatcctgcaaaaatgtaatctctatacagggcccttttatcccgttgcttgctccagagcctaaaatgcattccatcaggtctattaaggtatatatagtaaaatttactaatttttaggtttacagttctgagtttcagaaaacatacagtcatttaaccatcaccacatgaatacatggaatattctcatcaacccatatcaccccactgacagcctttgcagtcagtccctccatccattctcactcccacaaccactagtttaatttctctcccttttcttgaaagttagataactggaccatggaatatatagccgtttgtgtccttctttcacatagcacaatgcttttgagattcatacatgttgtggcatgtatcagtagttcactcctttcattggtagtattgctccattctgtaaatgtactacaatttaatcatccattccatagtagatagaaatttgggtttatccttctttgttagctattttgagtaaatctgctgtaagtattttcatgtaagtctttgttgacgtatgctattatttcttttggataaatacataagggtgaggtggctggatcataagttatttgtttaaattcataagaaactactaaactgttttccaaaggggctatactattttctttgccaacagcaatgtatatacgttttagttgctctgcaacatcatcaggtattgtcagtaatctttgctttgttttgtttttaacattctagaaaatgtgtattgctattttactgtgggtttaatatgaatttctctaaagaaaaattatattggatatcttgaattgtctgtttgaaacttgtcaaattttctttgggttgtttgttttattcttattgagctgtgagagttatttatatattctggatacaagtcctttatcagacatgtgttctgaaaatatttctgtctgcctgtggcttgcctgtttatttccttaacagtgccatttgaagagtagaggcttggaaagataaagtcaaatttattaaatttacttttgttgtctgtgttttttgagtcctttctaggaaatctttccctaacccagatcacattaaatttccccacaagttttataggttttggtttaacatttacaactatgatccctttggagtcagtttttaaatatggtacagcttataagttaaagctcatttttagcttgtggtggtcctattgttccagcattatttgctgagaatactatcctttcatcactacttatttagtcacctttgtagaaaatcggtcgatcatatgtattttggatctctttctagactctgttttgtttcattgatctatcattttttcttgacattgtaactttacactaagtcttggaagcaagcaatgtaagtcttccaatgttgttatttttcaaaattgtattggctattttagacagtatagcccaatataaaacaaggcctttaaaaattgaaaatcatttttaaggatgatttcaatcaccatttttctatataaatctaagtagatgactgaaaatcatcatgagatctatttagaaaaagggtaattatccccatcacttctccatttaacagtccaatttggcctgttcttaaacttggaaaggttgaatggaacctcataatggcttatctcagctttaattcttggtcccgcccattaaggcccatgtattaatttcatattattgctgtaacaaattaccataaattaaagggctttaaatacccaactctattatattacaactctgtagatcagaaatctgactcgggttattatgttaatatcaaggtgttgacagaactgtgtttctttctagaatctctaggggagaatttgttttctggccctttccagcctctagaagctgtcctcattactaggcttgtaacccctttacatcttaaaaactagcaatggccagttgagtctttctcatgtcacattgctgtgatgctgacttttcttctgcttccctcttctacatttaagggccttgtatatttatctgggttcactggatgatccagaataattgtcctattttaagatcactggaatacaaaatttacattccatatgaaacattagtactttttagccatctaactttttctctctatatatatttatatagaatgtatttatatattattaattacataaatatattttatgtaatatacttatatgttacatatataataatataatatgtatattcataggttctgggggttaggacatgacatctttctgagaccattattttgcctaccacagtcatgatgtattttccttagtatatattgctagattctgcttgttaagatttccttaaggctttccacatttttgctcctgagggatatttttctgtacttttcttgacttgtgatgcccttgtccagttttgatatcagagtaatggtggtgtattaatgcaatgttctggacaatgtttcttaggcttatcttttctggaagagtttgtttgtaattgatgtgatttttttcattaaatgcttggaagaatttgccactgaagacacacatgactgaagtttttgtgttgtttctgtttgtttgtttggatgtttctaactatgaatttaatttctgtagtagatataggacaattgaagttgttgatttttttcttgagtgagcaacagtagtgcctttcaaggaatttgtctatttcatttaaatgatcaaatttattggcataaattgttcaaaatagtccttcgttatattttttaatttctgtaagatctgtagtaatgccctttcttcctttctaacactggtaatttgtgtcttcttttctttcttcttgatccatctggcttgaggttcataaattttattgttcttgtgtgagaaccaggctttggcttcattaatttttattgcttttctgttttttctgccattgatttgtagtctttgtattttcgtaccttcttcccgctttagaatctaattttgctcttttttctagtttcttaaactagacgtttggataattgatttaaaagctttcttcttttctgacataagctttttctgctaaaaaatctttctctaagcatgttttatgtgtgtcccacatattttgatatgttttaattttcattaaattcaacatattttatgatttcatttataactacttctttgacccttttttttttttagaatagtgttgtttactttccacctaattatgtatttctggaataacaatttcaagtttaattctgttgtagtcagaaaatactttctatgacttcaattattttaaatttattgtgtctcctgtggcccagaaaataggccatttttgttgaaagcaccatgtgcacctgaaaccaatacatattgtactgttggctggagtgttctataaaagtcagttatgtcaattttgttgatagtgttgtatagatctatattcttgtttatttttgtctacttgttctattattaaatgaaagaaaaatgttgaagtatccaactgtaatagtgtattcatctttgttcccttttagttctaacagtttttgcttaatgtattttaaaattctatagctaggtacacacacatttaaaattatgatgttttcttaacaaatttaataatgatatataattcaatttgttaagaaaacatcataatcatctctggtggtaatattacttattctgaagtgttcctggtgtgatattaattaatataaccattccatctttcttttggttaagatttacatgatatatcttatttttattttacttttcatctattgatgtttcttctaaacagcatatagttgagtcttgcttttacagccaatctgaaaagattgaactgttctgtgggtcttcagatcatttacaattagtggaaatattgatattgttacatttacatctataccttgatagttactttttgttcatctgatcttttctttgttcatttattttcttgtttcctttggaataaattggataatctttatgattccaatttatctcctctattgacttgtttatgccatttttcaaaattttgtttattggctttactatagtttacaatatacatctttatttaatctaagcccaactttaaattatattatgcaaattcacatatagtataagaaccttacaccaatgtttacaatttctacttgacatctattgtgccattgttgccatacatttcgcttatacgtgttacaaaccccaccatatattgttactattttttatcttgaaactgtctgttatcttttatcgagattaaaatattcaaaggatgccttttatgtttagttttatttttaccattcctggcacttttcattactttctatagatccaagtttccatctggtgtcatatattttctgccttaattacttcctttaacatttcttatggcatttgcttgctagaagtaaataatctcagcttttgttcatctgagaaagtcttcattttcccttcatttttgaaaaatattttcaataagtgtagatttctgggttgacatatttttcttgcaattgtaaagatgccacttaattgtcttctggattgcatagtttctgattcgaaatccactgtgactctgattttgttcttctgtatttactgtgtctttttaccattaatattttttttatagttggttttctatctttatgttggtgtgtgtgaatgtgtgtgtgtttattcacaacttgttcctctcagcttcttgaatgtgtagtatatagtctttcattatttttggaaaattctgtcattatgttttcaaataattctgccaatttttttctgccttccatttctgagacttgaattacttgtattttagtcaactatgtattgtcttacagctttttgatacttattctttttacttttctttcttttgcattgtagtttggataatttataatgacctatcctcaagtttactattctttctttgactgtattatgactactgggagagggacaggaaatccctccatcaaatttatttattaataacttattttgacttttttatttattaacagctccatcaaagcaattattcatctgtataattttattacagcattactttcttattgtggggtttttaaattttctagcatttccatttcactttttcttagtgttttgattgctatgctaaaatttcccatctgttcatacatgcatttccatattttctgctagatctgttatcatattaattgtaggtattttaaagtctcttatgtaatctttccaatatttgcaccatctctaaatcaggtttgattgattgctttatttcctggcaatcgatgattttttattgcctttgtttttgtaccttattttttatttaatgtcatacaatgtgtatagaggaatagtagagactaaggtaaatagtagctatacctggaaatggccttcagtcttcttctataaggctttttaattatgaaattgagccaacccactcaggagttgagcaagccttgggatttgtgctatcattaccatcagtacaccacaggttttaaattctcttagtggactgctgctgctaccatatgcttggaattaaaattgtatctagagagtttttctcagtgtttctagttccccttcagctttcagctgctcttgcatgcctgggccacagaggggactctctctccatgttcttgcccttcctccaatagtaaaatgcttttgcttgttatttggtgctcactgctcatagggaaatggcatgttctctgttatggtccggtctcaatctctagcaggacttgcacacatgagcttcagaaatggggcttagtagtgttcctcacagtggcaatgaaactctgctttgtaactgtggttgttcttgaataggaatttcctgtccctctcgcagtagtagcaaacctatgtttggtatgtttgtaggatcctgtgcctaagaaagttctctgccccttctctggaggagagggttttgcttatattctttccccaggaaagatttttcttgagtcctgggtgcaagagagtttatactctccctcagagggtttataacctttcctcagaggcagacacgttttggttctactactccccagaagtaataagatttttgactgtcatgggagtgaggggagtccctgtcctatccctagcatcttaagtcttttgcttcataggagagaagagtctgagaaagctgacagggaagcccttcccccaaacttgaacacccagtgtaggcatatggaaaattgcatgtatgtgaatgcaaactccccttgtgtcagaaacaaccagcaactgtatattgacatactatttcaaactcttccctaacctgtatcttatgttgaaattaaggcagtcttttcattgttcccatacacgggttcgaacctgttctgtatttctttatgctgcccctcttgcatggaaagccctcttcctttttatataaattcccaaatcattcctagtcaagctcaactctaatttcttccttggtaattccagccaactttaatttctcccttgttggtatctcttataacttatttttaacctattattgcctccaatttacaaaaggacattaaaatgtgtacaatttagtgctttattccactgtattatattattctcttattgtgtcgcaagacctagccagatgtacagtaggttcctactgtcctagcaataaactttagttagaaaaaaatgtattaacctcctcttgtgtaacattgactgcaataacaaaataaacacagctattccagcttcttttgattagtgtttgtatggcattagcccattagcagattagtttgacaaattagctctgaaaggcagtgtaatgctgcagaaagagcttgcacatttaaagtccaatggctctgaattgcaatcttggctccaccgtttatcggctgtgggatttatggcaaattatgtaacttctcctgaagattaaatgagataatattgtctactgggcatagagaagatggtctaggatgaagagacataaaatgggttgttttctggggacaagagagggcaaaattctggaatgtagtttgaaaagggtaaagccaaaataggactttgtgtgtgtgtgtgtgtgtgtgtgtgtgtgtgtgtgtgtgtttgtggtggggtgtggggggggcagtgacagtacagggtaggacagcaaagaatgtagtagtatagttttaaaagtattggaagcagaatcataaatatctaggttcaaaacatgcctctgacaccaattagctttgtggaccttaggcatgtcactacatcttatggaactccattttctataccattaaaatgagggtggtcattaaatctgcttggataattttagagagctgtctcaagaatcaaaagaagtaattctgacagcaagttataaactataaagagctctgcaaaaaggtatggcatttgtaatgatagtgacccaaagagggaagcaaacaagttccctgcactaccagccctgttcttgtcaaaaacgatgtaagtcaagttgctgccagatcaattcccattcagaccaggacttgggacagtgatcacacacgtgatttaggacctcagttttctgatcttgccttaatcactatctcagatctagtgcagcctcagggaagttagatgtgaagttgactgttatggtctgaatgtctttgtcctccaaaattcatatattaaacctaatccccaatgtgacagtattaagaggtggtgcctttggcggtgattaggtcatgaggactccaccctcataaacgggattagtgcccttataaaaaaggcttgagggagcgtgttcatcctttgcccttctgccatgttagtatgcagcaaaagggtgccatctttgaagcagagagcatggcctcaccaaacactgaccatgctgacatcttgatcctgggcttctcagcctctagaactgtaagcaataaattatgttgtttgtaaattacccaatccaaagtattttgttatagcagccggaacagactaagacattgcttcaacaggagcaggacttgagtaaggatttggaaaatgccaattcaaaagtgaaacctggttcagaaaaattttgagtcttgacaaaatatcctgggacgatggggtgtggcacagggataatagtttgccatttactaatacagtgaaggagaaaaatatggtttgtgggggtattttcctatttccagctctgagttttactttattccagagaatggtgactttcaagtaaacactctagtattcctcaaacttcagctgccaaggataggcagtaaattgtattgggaatttgtacagcaacttttgtttttaaatgatcaagttagggaaaactttatatgctggggccagtaaagaaagggctgggagcagtggcacattaccactttgggagaattccgtttgtctaattagcccaggaactcagactactctaagtctgaaagtatatttgtgttgtgtgtatgtgtgatcatttgtatgtttttatctgtatattcatggatttatatctgtatgatagtatgcttctgcctggttctttttgttaccttttgtatgtgactgaatctgtatgtatgtcctgttaacatttgagtttgtgtctgtatgcacatacttatcagggttctgggattattttaagactttggtaatctatggactctttcttataggataagcctgtgaacaaaaggaggtgcttgttcactgagaaaattacaggctagactggaatttgctctgatatttaaaggctgccccctcaatcaatgcctcctttctattcccacaccaacaacgcatgctaccttctgattgtccccaactcctactcagatcattttcccacagagatagggttctgttgagggatgattgggacaattccacacctttcttttgagtgagtggaagatgaggtgttaccagagcagggggcttttttccccatcccagcttcccttcagttattgaagaattgcagttctggcctcaattattttatgtttacctgcctggaggtctgctttccatccttttaggcaagtttcagaatggggcacagagactgaaattttggagaaaggcttgcctccttcagagaaagtctgttgttgtagactagaaagtattagtttggtgcaaaagtaatcgcgttttttgccattgaaagcaatgagatctagtagtgagaaattgaattagtcagcaatgctcgtaggctaccttggaaactcagtcctactcctgtgttccgatgagagggcaggggtacttccctaggtgggcctctgattcgtttattcagcaaatatttgtgaaatacctattctgcatagctccagctccaggagcagaattatccttttgacaggatcctttgagagataatggctaggagcaacttgtggtaggaattgcaaaccaggccatgggggagagcagtggacttcaagaccccacaggaaaggtggaactctgtgcagttccttaatccccaaagataagactgttcagaggtcatggttctgcttttctttctgctgttgattccaagttggttaccccataattggtgaaacctgtgggttctgccttccctttcgtccctccctttttcccatgcttcaaagccattttatgaaactcctcaggagcaacagtacttgaaccacaaggtgcttttatgaactgcagccacccagagtctgaatcccgcccttcacttctgttaatgcagggttgaaagtggctttttctttttcttttttttttaaatttatttatttattattattatactttaagttttagggtacatgtgcacaatgtgcaggttagttacatatgtatacatgtgccatgctggtgtgctgcacccactaactcgtcatctagcattaggtatatctcccaatgctatccctcccccctccccccaccccacaacagtccccagagtgtgatgttccccttcctgtgtccatgtgttctcattgctcaattcccacctatgagtgagaatacgcggtgtttggttttttgttcctgcgatagtttactgagaatgatgatttccaatttcatccatgtccctacaaaggacatgaactcatcattttttatggctgcatagtattccatggtgtatatgtgccacattttcttaatccagtctatcattgttggacatctgggttggttccaagtctttgctattgtgaataatgccgcaataaacatacgtgtgcatgtgtctttacagcagcatgatttatagtcctttgggtatatacccagtaatgggatggctgagtcaaatggtatttctagttctagatccctgaggaattgccatactgacttccacaagggttgaactagtttacagtcccaccaacagtgtaaaagtgttcttatttctccacatcctctccagcacctgttgtttcctgactttttaatgattgccattctaactggtgtgagatggtatctcattgtggttttgatttgcatttctctgatggccagtgatggtgagcattttttcatgtgttttacatttatgcagccgaaagtggctttttctgagccagctcctgaggagtcagaaacacccacacttgggagataggacaccttgattctggttgaatccttgctgcagagccagaaaaatgtaagtatttcccttttctagccattgaagaattacatgtgaacaatctttaaggcctcttctgctctggaattctatgattacttctaaaaatgattgcttcaagccacttcaatctgcattaccaagtgctagagacaacgtggaatagatgtactctctgagaactaaagttcttgccatttacttatagatttgaaaaggaaaggagctgacatttattaagtgtattatgagccaggcactctcttatattgtccattattatttcaataataattcataacctgaagaaatttggggaggataaagtgagtgcttatgtgaagcagagtacaatgcctggaaggaagtctgcactcagtaaatgtcattctctggctcctccttcagctcctcttttacccagctcccagcctttaaagagataaagaaacagaagctcagagggattatgtaactgcccaaagtcacccagattttcagctgcaggggccatgtgtatcctgttatattacactgcctctgcaatgtgaagtctatagttattgcccctatagttattgtcccttgcttggaaacctcctactttctggcccagttcctctttgtgatccaggcctgtgtttgggaagtggtcacccagagatttcaggtgcaccacacatttccctctgcagtattataactggtcccacagagcgtgaacactccatatagacattgttaacttcagactctcattcttggccaaccatcccttagggcagtcctctgctcaccgaggcaagggttctgtggaaactctgccctccagctctgttcccctgacacagatatgggaagatgaccatatgggggaagagccaaggggtcattttcaaataatagaaaaggtaagtttgcttgctcaggattgaattcagaaaatcatatccttggctggcagaatattgagcactggagcaagagtggagggtgtgggagtagctacgagaagagatgaggatgaacactgaccccagcgaaggaaggaggtaggctgggaattgcctactgagaggtattgtcattggcccacatattagtagagttgaacaggggaagttgctgagctgaatgacagaggactgatcttaaaggcaacttcatgccttgaagataatcttcttatgaaatcattaagtccatttgttctacattaggctttcctgtgttgccctttatttagcagaaggtaccatggagttctatttctagtagtaaaggtgattttgcatggatcatgtcccactctggtctaatacccagtgtgcatagaataatcctgggtttaggatggcatcgatgtatcttttgtataagattaagcaggtggttcagaaatgctatttcgtggtagctagacttggtggttttttgtggtcccttccatctccagggttactagcatttttgagctctctttctttctccccctaccctcagccgcattctccctatctcctccttacacagggcactttctctcctaggctacagagggcagtccacctaacagaaccctactgctggggaccaacaatctgggctccctagtggtgtacaagatgatccaaaatctattgctttgcatacagtaaaacatagtttgccttctagaagtagcacaatattctggaaagagtgcaggctttgaagacagacaaacttaattttcaatccagatactgccatttcctagctctatgatggctagcacaacagttgaacctccttgagctccatatcctcatctgcaaaattgggataatcctggttctcatctgctagtggtgttgtgaagatttactgagacaatttatggaaagaatttagctcagtgcttcacacagagtatgtgctgaaggcatggttcttgaatgaacgagtgagtgcatattggtgtcattctttcccttcctccctatgatgaagtgctgttaaaaggcttctgctctcctttaattaagtggtaagagcatggatatagaattcagccaattcagggactgctgtgtgatcttagttagtagttaaaaaattatctgaggctcagtctctttatgcatgaaatctggataacaaggccaagtgtgcagagctgttgtgacgattaaaggaaacaatgtatgcgatagcacaggacctggaacgtggtgcgtaattgataatgccaggtcctttactctgcctacccctaggcactttcatgtatgtgggctcatttagttctcagaacaaccatatgaaatacgtattatcatcataatgagataatgtatgtggaaggcacctagtacaatatgatgcaggtggtcagtaagtgtttgtttccttccctttctttttcttcattaagacaattattatcctgccaacaatcgtgctttcgcatgaactatgaatattttaaagaatgaggtgctaatcttatatcgttatcaatttagaaggcagtctggacccctggcttataatcaaaattatgttgattttaataagatgacaaaagatcacagagtttatagatataaagtgcttgcctaattcctgccttgttatggtaagttatgaatagattaatttgatatttcagaatgtaacagtcattaagaaagcattttcatgtaagttatagttttacatattaacgccatactttccttagcatctaaaagtactgttctttacttaccatgagaaggagaaagttttggatctgtatttgtagaactggggattagttggggttgagttcttttgacttgaaactgatctcttacctggtttcacaccttaccctctattatcttctatgtcatgtattagaatatgatttagagagggccaaagagtgggtaatatttgcaaggcagagagctttatggtgaaatgaaatctcatctgatctatgagcaagttacttcacatcctttttccttagtttcattattggcaaaataagtataatattaacatttacctgacagggttgctttgaggattaaataggataagttatgaataaataagttaattcatctaaagactttaacatagagttcactgtgtagtggactcaataaatgttaacagctggcactgctatggccaccaccaccaccacttccaccactacaatgataatgatgtgaccattatcttcaagcactacagaatggttaaggaattgggtattctgtctcatgaggtacttcagttctctgaagggtaggctgagaactttcttaatttcaactccctttttaaaatccctccaagggctctgtgtccatattgcttgagttaccatggaaagtctgggatcaacattgattcttgatacactaaggctctttcagggccataggtggatcattcatatactgttaccattgtccaaagcttcagctgtagaaggtgtaggaaactgggctgaatgttatttgaatgcagagaagcccttgaaaatttttgtaatttgaattgtgatcatttctattttaatttttcttagttcccacaaagcaaactttcttagttttgttgagtctcagctgatcagaattttataagaaactttttcctgtctctaaataaacaagactgttatatagagagatttatctaggtgtcatgcatattcaaggaagtagggaaaaggcaatacaactaggtttagtgaattctcttttgaatactgaccagttgtttggctgttctgaagactaaattaatacaggtaaatttcctaagtggcatatcgatggctcaggtgggaatagtgaacctggatgtgttgtccggaaattttcaataagttacagaccagtgtgtgagctacagaccagtgtgtgagcatgactttactgacaataaaaatgggaggtaacgagagccatggacacttttgtcccatgaattctcaaaaatgaaatgatgagcggttcaaataatctgtgtgaatgcagagggctagacactagtggtctcttatggtttcttctacctccagggccttaagattctagaatgctttactccagcaccaatctttctttagatggttttcttagaaccacccctcttccttcttccttccatgccttatattctttatattcttccttcccaaaatattgtactgactgcacactaaatgcctaagcactgttctaggcattggagtacagaataataaagagaaatgctcctcaactctcatgggttcggcaatttctaatattctgggatgtccctgacctgatggtaggaaaaagatggctcctcagtcatggttgaactttattttgtacatacgcaattccttataagtgagttttttcccccttttctttgacttgcaggttttgaaatcttggacaaaaggaacattttttagaatgcaagtgaccaagttgaggtggcatagaagtgaggctgaggtgcctctgacacagcctcatagcttaagcagctcaaggtctctcctgcttgctatgctcacctggattatagagagggggtgggatgtgtataattaaaataaaccatcaagcaaacaagcaaacaaccaaacaggatcacaaggaaaaacaaaattcaaaccaaactgaaagacaaaaagaaaataaacacacaaaactcctctttccagtgggccccacagaaagtttctttctttgtctttgaagggctcagtccatttttcttttagttacttgatttgatattgaggctgcagcattaacacctggtaattaaataaatggtcaatccactagctttgtctaaaagggaacttaggaccaggctgcctgatccccacaagccccctcccttgcaaaaacaaacaaacaaacaaaaacaaaaaagaaaagattcatcttggcgtcagttactgacactggttcccaaaagggagggtgtttgtgaaatgcccttctggaagaatagaggaacaaagctaggtgttctgtcggtgtaaactggaagcaagtctcagcatgctgggactcagcacgctggggctcaaggcacgctagcaccatgggcaggagttggaaactccaggctgttgtgcttaagaaaaagaaaatttattatagagtttcatccacttattcatgagtacatcaaaagggtattaagcgctgactagaattgggaataaaagagtaaacccaaacatcttttcacttttctggactcaacaaacatcatttccatatgttaacaacctccaaaggggaccatagccatcagtcaagtaaacaataatgttgagaacaaaaatgtgagtccactgatatcatacttttcctcttctttaagagattcttaactgactgacttgtttttttctagcccagagaagagaaaacctagatgtaggcgtagaatgggacctaaatatctctcttcaattatctgaaaggctacatgtagaaaaagagttagatctgttatataaaatcaatgagcagaccagagatgaatgagcagaatttaaagagattctaattttggtttatttctaataattagagcttatcaaatgaataggtggtcttgggagccaataataagaacaataataatagtgataattgctattgttatttttaatgtattttgtatagtactttaactttggaaacactgtgcctcatttaatcctcagtactcattttgtatatcagtcaaggcagatatcattctcctgattttagagatgaagaaactgtgtctcagagaggttaaggatattacttcaggtcacacagctaatatgagataagctggaattcaaatcaacacctgttgattggttctgagggagtgattaaggaaggactcccttcctcagcttgtttcaaaatgtaaagaagctgccttcagataggaagaatcaaatggcagctcaaacttcccgtgaagcaagggacatttaccaggccacaggccagtgtagaactgtgctctgcaagccaatctggatgaaagtgaactattttatttttatttttatttttttttttttgagacggagtgaaagtgaactattttatttattgccatttctattttaaggctgtgttctctgatttcaatgtaaaaatgtaggtctgggctggtggatggcatcatgtacaccattctctgttcatcacagctgcagtcacactgtctcctgtgtacactgatgtatgtttgcttgcacatataaaattactttcctgggactgcaaacacaaaccaggctcacaatttgcctaatacagtgaaggttgcaaaaagaagcatattttaccatttcctgcataaaaagaaacaacagaattaattcatttgattgacttgcccatttttcccagtagttttctcggcatggggaagacaaattctccacgagtgaagactgtatgtgtgtgtgagtatgtatgtgagggccaccctatagcaagccctgttctaaaacttgtccttttctcttaatatgttttccaaagttctgcttgataattatggattgtatctggaggcccactcgctaaaagcaggttgagtcataagcaggttgtaagagtccaggagacctgcagcgatgactaagagagtcattatttgatgaaaaggggaaaataggtgttggtttgaatggaaggctgggggagcatgacggacttcttgagcaggggagaaaaaaaacccacttggaagctagctggcagggtgagtggggaccggagaaaaccggtcttgtgcagtaagacttgctgctgcattttaatcacatctcgatgtgactgtttttttttcccccctctttttgttttttcatcaagaaagaaaggactcagagagaattcagcagtaacctagctctttaaactttggactatactctgctctcttgcacattttaaaattgacacctagaaatttttcatcataaattcaagtagatgcaaataccgtatactttttgtcaccttgtaaatattgagtttaaattaaactcttgcatcactcttttaacttcttcaatagattctaagtaccatagtatttttatatccattgccacccattaaaatactaatggaaaaggtctctaacagttggatatttaacaccattaccttttcttcttcaactcacatttccattcacttgctccacagagttttatcctaatatctttcatatttttatgtggaaaaggcttttcttgttcatcctattatgtatcccaataaaaatatgtatataaaatgaaatgaaattttaaaccaaatttttctgtgaccagaagtctccaaagtgttaaaataaataagtaagtaaataaataagtgttacgtagcccaaaagtgacagagtagtaattagaatctaggactatgctctgacttccagatctcatccactctgctctgctctactctggaacctcagaggagaaagtgagcacagccatggtaagattcaagatgtctgataggtagtcctttctcttataacgtaggaggaaggtaattgtgaaaggagaggggagaagggaggaaccagaatgactacctaacctcaagcaaatattgccaaatgtcccctggtggggcggggaggaaacaaaatcaccctcagttgaggatgcatactccagtttgaacattgattgcttatctatcttattaggaatgtgaaaaagacccaaagcagtcaaatgtattatttgcactttattcaggaaaagggcaaaatctggttgtttgtttaaattctctttccagggtgggtgcggtggctcatgcctataatcccaacactttgggaggccgaggtgggggaatcacctgaggtcaggagtttgagaccagcctggccagtatggcaaaacctcgtctctactaaaaatataaaaatgagctgagtgtagtggtgcacgcctgtagtcccagctactcggcaggctgaggcaggagaactgcttgcttgaacctgggaggcagtggttgcagtgagccaagatagtaccactgcactccagcctgggcaacagagtgagactcggtctcaaataaataaataatctttgcacatgagtggagagggggttgttgaatccatctcaaaggttttggggcctgatcaaacattggatctcaagggaactaaaattagatgtaaacatatcaggggaagggaagaatggagaagaggaatgaagtcacaaacaacagaaatcataatgaaagctgccatttactttgtgtcaattgctctgctaagtgctttacatggagtatcttgttgaataatcataataacctaggaggtaattgtaatcatttgttagttagagtgcaggttaggctgttgtaacaaaaagactaaaaactttcagtgacttagacaaaatagaaatacatttatttccatgaaagggccaggtaggctgttcagggttactgtggcctccaggctgcttctgtgctgttcctctgcaatttcaatccccagcttctatcacatggtcccagatggcaactctggattctgctatcaggtctgcattccagccagtgggaaagatgaaaaggggaaggtgagaatatatacttttcttctaagggcacaatctaaaaggtacaaacctcattccatttataccctataggcttgacccatcttgtaaaagtaatgtggactttagccaggcagccatgtatccagctacaggggcaggtaaactacacactgaggtccaacaacctctttctggtaaatgaaattttaatggaacatagccactccaattcttctatgtatcatctatgctgctttctcaaaacaatggcattcttgaatagttgtgacaaagactgggtcgcaacagtccacaaagcttaaaatattactctctggtctttaagaaaaagtttgccaatctctgatagagaacaagaagggaatggatatctagagacacctaaggggccctgtcaagattcttatttaacaaatgaggaaacagaagcacatagaggtcccataaaaagtcccaaggtcacatatggataagtggcagagctgagatctgaatgtggttctgtttggctccgaaggcaaagcactgttcgctatatcatactgtctcactaattcatatagcaaatatttattacatctattctgtaccaggcaatgttctaggtgctgaggattcagtggtgaataaaagagaggaaatatctgctctcatgaagtctacattaaaggaaacagaccattagaaataattaagcaaaatatattatacctcagaggtgatacgtgttataaataaaaatgaatcaggaaagaagggaagacagtgacagagtgtggtagggattcatttttcaaacaaatggttaattatggcctcaatattggagaaaccaaggagaatgagtctgagccaaagctcttgagaaggaggcaggagcctgagttgagaacacccagtaaaaacccagagttccccctcaaaagggaggttaaaccaaaggtcaggagctgtacaggaactggagccaaaagaacaaagacagcagtgtgggcacccatggcttgtgtgtggtgtgtacactgtggtaactggtacaagtgggtgtgtaggaagagagcttgcataaaggtacacaattacacagaagagtttgcctttaatccttttagacagaatcctaaagactctttgcatgcagacaaaaaaaaacatgcatgcacagacgcacatacatgtaaatataatgagagcaggcagtaagtcagtgcgatctatggaaagatcatggttgttgcagtcccgtggaactgtgaatctcagctctgccgcatgctgttttgatgactttaggcaaattgttggtactgtttttagtcacgatttattgagtgttttgtatgtggcaggcactttatatacatgattcatctaatctttacataactctatatagacagatgcttgtaatatcttcaattattttcaagttaaattaagtggtaaaattaagtggtgataggtgacagtcaagaagtaatgagaaatgtacaattttcttcctgtgcatttatattgctttattttatttaagtatagtgattaataatcttggttaatgtttccgtgggctcatttttattaaaaattttgtattttgaaagtaaaaatatttaatgcttgtttagtgcttactatgtgtcagacaccattctaattactttacatgtacttctcaaaacaaaactgtgaggaaatactcttatgcgcctcatttttttctgagatgagaaaacagaggcacagagaggttaaacaacttacccaaggtcacacagccagtaaacagagagactgagatttgaccccaggcagcctggctctggagttcatgtgtttaatcattacactacattgccttacaaaacagaccaataaccatattgaatgagaagacatgctagcttctctttcacttctggtgatgcatgtggaaagcctggttatttgtactttgtgatctaacccagggccactacctctttagtgtcagcacatctgaaatggagaccaagtcccacggagcgaatattccacttctagaagactaacctgggaaacccaaatttaaaaagtgatagtaaagatgacagcatgtgtgctctttgtaagtgtgactacctacaaatgtgtgtgcatgcgtgtgtgtgtgtttagatgtgtacatgtgagtctaactagtagttttagatgtcaggggctagcctttctccccaggagcctaaaatccaactttttatggagcaagatttagaaataagaaacccttattttgtttcaggatatatacctggttttccagaatctattttctctctagagaccagttctgcttcctcaggcatgtaactaccaaacaagcatggatgctccagtaacaccaatgaaatgattctctgcttcagtcctagtgtatcagctctcatttcatgctccgatcaaaaaggccaaacataatttgctatctggccggcctcttcttcgaattgtcagcatttagtaaggattttctgtgggaatatcttctgtccaaaatggcatagaagattccaaacatgggctctacatgtcacctttgattgtgaatttgggagcctcaacttgttaccagtacaattgtaatctagatggctactttagggatgaggatagatttttcactgagccactccttctctcatttagtctcctcatccctattccataccctaaccagatgacaggttcagctgacttctagaaacagttttctgaggaataatttaactggctatgatgaggaccaatccgcaagaaatgccctcatcagcacagtgttctaatcactgatagaactagactatgtggaaaatctaagtggtagagtgagctgacatattggtatggagaagctgacatttcatcaggaactattgacttctgtggggccagaaaataccactacggtggtgaccgagtttatcatactggggtttggagacctcaaagaattgagtcccttgtccttcctggtgtttggggttacctatgtagccatcttttctgggaatcttcccctcatggtactggtgagcactcgacggagacctcacactccaatgttgttctttttggtgaacctctcatgcctggagatctgttatacaaccaacattgtgcccaggatgctggtggacctgttgacggaaaacagaatgatctctatggtgggttgtatcattcaagcctacttatttttggtcctgggcagcactgaatgttatttactggcaatgatgttatatgatgggtatctggctatccatcagcccatgcattattaaaaactaatgcatggaaccatgtgcgtggggatagtaagtggctcatgaacagtgtaagctgcattccaggctgctatggtatcaaatttgaccttctacggtggcgatgaggttaaccatttattctgtgacttgaaacctctgcataagctctcctgctcagatctctatctggtcaacctagtctgcatgagtctaacagctctgttgacccagcttcctttggactaaccctaacctcctactggaggattttttcaatggtgttgcatataccttccatgactagtaggcagaaggcattctgtacttgctagtggttgtgatcttgttctatgggatcttgatcctggtctatgctgtgcccttggctggccaagtgccagctctcaacaaaaccttctccttgctctacaccattgctgctcccatgtgtaatccccttatcaacagcctcaaacacaaagatgttaaagaggctgtgaggaagctgaggatttgatcctacaatgatgaggttcatacaactgacaaaaattagggcaatctggaggtcaaggcaatgtttttgtcctcaagaaatttccaatcagattagaaaaacacaggataggtggggcgtggtggctcatgcctgtaattccagtgctttgggaggctgaggcaggcagatcacctgaggtcaggagttcaagaccagcctggctaacatggtgaaaccccgtttctactaaaaatacaaaaaattagtcgggcgtggtggcacgcacgtgtaatcgcagctactcgggaggctgaggcaggagaatagcttgaacccaggaggtggagactgcagtgagccgagatcatgccattgaactccagcttgggcaacaggagcaaaactccatcagaaaaaaaaaaaaaaagagaaagaagaaaaaaaaaagagaagaaaaggaaaaacacaagatagattataatttttataacctcaaatattggataattgccaaatattctgattttaggggaagagttgttactagtctccttgaaataatctagtttttcttgggcatatttatattgcaagaggggaaaagtacttttgagtttatgggaggtaaaccattctgggatagataataaataattgctccacacaatcccccaaaggtgcaatcttggaagtagggattggcaggtaaactttaattgtgttcagtttcattttttaaaaaaatcacacctggaggttctggaggtggaggaagagtgataactgtgttaccctcataagagaggagagctccctaaataaatagtccatgtttatttccttcactgcctagactacagttctggctatgaggctatgataataattttggacttctacttgacctgagattaaaaagataaaaattgaatctaatagaacatatggaaacccaccagtaggctagctttggagaaatgtgcattaagcacttatagcaatttgttagacatgtggattgcctcacggcacttttttcgagattgcattttttttctagcatttacagctacctgctgcattttcatctatttatttttgttcccctcccaggtccttttcctgctgtgtacctgagtttacctcgctggcttcacttgtgcttctgtttcttattttcctgttaccagctacctaacattatcaactgatatattcaagctacactccaagggagagtaaaagcaaaaagagtctgctctgaaaagcagataatgcacttattaatttattcaagcaaaaatatttattgagagcctaatattatccagtcattgtgctagatgctaggaagagaatagtgaacaacatagatacagcttccaacctcaaaaatggtaaaatctggtggccttagtgttccagttgctcggaatttatatttttacattgtttatataatatgtagatcttgaaagaatcatttctaaagagaatctctgcatgtcaaatcccaatattgttatttaccttcattttaagagtaactataataattaatgggaaacaaccttatgtaaagacctaataaatcttttagtagaacatgtaaacagagaaatactcagaatgtccctcgttgagctaaactcaccctattttgtcctttaagattcaactccagtcctaccttctctttgaaccctccatgagtatgctgcttatgtcatttctccccctgagaagtgctttatttctcttcatctgacatgtaggatgcactgctctgcactttttatatatgtgtcctgtcttctcattagattgtaaacccttaaaggacagaggcagaaagttgtttctagctgtatcctcaagcacccagcataattcctgtgcacacagtcagtgttcgatgaccatcttcacaggataaaatccaagattctcagcatgaaattgaaggccttctattactctgttcttgtccctttctgcagtctcatctcccatcaggctgcaactcacaatttgccacattgtaccctgtgcatccttattcatgccctttgcctggaaaattctgcccatatttatatttcacctggctaatgcccctcatcttttaatactcagatccatcatcatcctctccagcaggacttgcttgaccgttttctcctatccaatacactgaagcaaatgatgcttttctgtgtctctacgggattcattgtagatatagtttaataaattattattttatctggttgtttgccagtgtctacagtgcctaggagaatgcttgggatgtgggagccactcaatgaatattttttgagtgaatggctcaattgtttatgtgccttcctccctcactaaactattgttatttccttgtcatcaagtaccacctatagcctgacaatccctcaataatttaacactgtgataaatgttatgaaggaaatgtataggaaggtatataacaaggttatctaatttggattgggttaggaatatcagataaggtttatctgaagttatgacatttgaacagagaactgaaagataaacagaaataagccaggcaaagataggttataaggtgaaggggggtagcagaggatttcagtggcaggactagctagcaacaaggtctgctgtggaaaagttcttagagtgattgggaacagagaaaaggctagcatggttagaatgcagtgatcaagggagagagtatcatagatgggactgggaaggtaggcaggaatcagataatgcattgcttcactagatttctttgtgagattggaattcttgaacaatttttagtcgagtgacatgatccattttatgttttaagatcactcagattgctacatggagaacaactgttgatgggactggagggctaatagatgtttggaaatcaattaggacactattacaatgttaccggtgagagatgatgttggtgtggactaagagtagtggcagagatggagagaaatgaattgaagttgatatattcagagatagaattgatatctatctatcaattctagataggtttggtgatggattatagaaggaagcatcaataataactttctggttactagtttgtgaattgaatacatgcttacaccactcacagggatgggagactcctgggatagggccagatttggaggagagaagtaatgatcacatcaactttgtgcaagagtattccaatatggcagtggctgtcaagtaggtagttaaatatactgatctggaactcagaagagacatctaggctagaaatacaaatttagatgccatcagcatgtaggtggcatttaaaagcatgagagtgggtaaaatcatgtagaggaacagtccagacggagaagagaacccagaatggagccctgagaattcctctttttgagatcatgtagaagaaaaataaccagcaaatgaggaggtgatagagaggtaggagaaaaaccctgagtgtataggttcatgcaggtagggagaggagaatgttttaagaaggagaacttagtaaactatgctgaagactgttgaggggaggagtaagctgaggacaaagacgggttcattgtatctgataacatagagggcagtgatgacctcagtaaagacacttttggtagagtgatgagtgcagaagccatattggagtgagataaagaaatgaataaaaggtgaagaagacactatatgtagataattctttggagaagcctggctctggaagaaaatagatttgatgagagctggaacaagaagcttaaaggaagatgtttgttttacaatgtaaataaaagaaaatgtttgaataccgttagaaggattcattaaagagggagaagtcttcattaaaggggtcttctttaaagacccggcactctccacgcttggctctcatttcatttctccacttggtttgccctgtggaccaaggtccctgggaaccttgggtatgcttcccccgcccctaccccaaatcagcagtccccacttcaggcagcttctcatgcatctgggttcctattgtccccaagggaactggatgcacaccatgcaaagccctccagtccaaccctgtcaccttgctcctgcccccatggagcctagctctgctaggactagtgcttaacttagcctaagcaggctcattaggtcagtttcaaggaagtagttctggctagaatgaaccaaaaaacaggtggcagctttggcaggaggatgcagtggagactacaggttgaagatgcagggatatggatgtattccctgcaaaggcaggaaggcccatggtccagagcacatgtgaagagtgtgtcttctgatcagagtgacacttacactgtgacaaatatgtactgaacacctactatgttcttggttttatttcaagtcctaaggatccaacaatgagtaaatcatgatccttgccccccatggagcttgcaatctgatgagagagataagcaattaaatagacaattataattaggttgattaatgctataagcacagggtcctgtggaagcactaggaagaggcactgttatgggttgagttgtgtctcccaaagaaagatatgttggagtcctaatgcctagtatctcaaaatgttgtcttatttggaggtagagtctttgcagaggcaatcaagttaaaatgacatcattagagtgggccgtaattcaatacaactggtgtccttataaaagcagaaatttggacacagacacagacacgcacagaaggagaatgccatgtgaacaggaagagactgggaacatagaagccaagagacaccaaagactgccagcaagtcactagaagctaggagagaggcatggaacagattcttccttactggaaccaaccctgccttgatgttagacatccagcctccagaactataagaaaatgaacttatgttgttgaagccactcagtttgtggtactttgttatggcagtccaagaaaactaaaccaggcatttaaacctattcagggtgtggtggtcaggttaagggaagacttcccagagtaggtgttatttgtgctgaatcaagataaataagtaagatttcatgggtagagcctggggaagacattccatgtaaagcgatcatagtttgcaatatctaggaagtgaaagggagtatagatggctaagctactgcaagtaatccaatgtgtctgcatgtagagcatgtgggcaatggtggtaacaactgagacctgagaagctggagcttctattcatgaagggccttctattcccagccaaggaatttggactttatcctgaagccaagtgggtggcctttaaatgttcattcccccctccactattcacccaccttacttcatttttccaggaagccttctcttacatttattgtggcacttctcacacagaacgataaacaagaattcgcttcttggtttcttccaacacatagtaagctccttgaaggctgagatgatgtcatgtttgctgagatagatatgtccagtgcctggaaagtgcttggcatatagtaggtcctcaataaatgattgtctggtatgttatttgtgactgcattgggatttcctggatctcttcagggtgatattccaggacacgccacattttcccttgactctgctctcctcttccttcctctcacggatgacccagcactctccacgcttggctctcatttcatttctccacttggtttgccctgtggaccaaggtccctgggaaccttgggtatgcttcccccgcccctaccccaaatcagcagtccccacttcaggcagcttctcatgcatctgggttcctattgtccccaagggaactgggtgcacaccatgcaaatccctccagtccaaccctatcaccttgctcctgcccgcatggagcctagctctgccaggactagtgcttaacttagcctaagcaggctcattaggtcagtttcaaggaagtagttctggctagaatgaaccaaaaaacaggtggcagctttggcaggaggatgcagttgagactacaggttggggcaatgaagtggctgggtttgacaggtaggtagggtcagataatcagagcaatctccaactaagccaaatttgacccatgggatccccgttgaagaaggcaaaacagagtactaaaaaaggaaaccaggaagaatgatggtcaaggcaagatgttaggcagaaaccatgtgttttgcattagattacattttttttttttttgagacggagtctcgctctgttgcccaggctggagtgcagtggcatggtctcatctcactgcaacctctgcctcctgggttcaagtgattctcctgcctcagcctcccaaatagctgggattatagtcacctgcccccacgcccgggtaaattttttgtatttttagtagagacggggtttcaccatgttggcaaggctggtctcaaactcctgacctcatgatccacctgccttggcctcccaaagtgctgggattacaggcatgagccaccatgccctaccagattaaatttattttttaaaaatgtacatcctgcacctgttgtttcctgactttttaatgattgccattctaactggtgtgagatggtatctcattgtggttttgatttgcatttctctgatggccactgatgatgagcattttttcatgtgtcttttggctgcataaatgtcttcttttgagaagtgtctgttcatatccttcgcccacgtgttgatggggttgtttgttttttttcttgtaaatttgtttgagttcattgtggagaggatgtggagaaacaggaatacttttacactgttggtgggactgtaaactagttcaaccattgtggaagtcagtatggcgattcctcagggatctagaactagcaataccatttgacccagccatcccattactgggtatatacccaaaggactataaatcatgctgctataaagacacatgcacacgtgtgtttattgtggcactattcacaatagcaaagacttggaaccaacccaaatgtccaacaatgatagactggattaagaaaatgtggcacgtatacaccatggaatactatgcagccataaaaaatgatgagttcatgtcctttgtagggacatggatgaagctggaaaccatcattctcagcaaactattgcaaggacaaaaaaccaaacaccgcatgttctcactcataggtgggaattgaacaatgagaacacatggacacaggaaggggaacatcacacaccggggcctgttgttggtggggaagggatagcattaggagatatacctaatgttaaatgacgagttaatgggtgcagcacaccaaaatggcacatgtatatatatgtaacaaacctgcacgtagtgcacatgtaccctagaacttacagtatattaaaaaaaaagaccaaaaaaagtacaccctttaatgccaggcatttcaacaagcataaacacacttcagcctgagcaatcttacacacacacacacaccccacagatgcaaagtgatgacacacagacccacgccagcactggcagaactaagtgtggaatggttggcagatactgtcacacctgatctgtttgcaattggcagggaaagtgtgattctctttatgtgtgcaagtaccaaataatagcctcattcattcaagtagccaagtacttttcactgtaattgtttcaaatgtatagctttctgtcttgtaataccaagtgaacttgatacaatttaactttttctggatgattccaggacatctttatgcatactaattactgtgggctgggctgagagatagagtgctgttaagtgctgtctcgaggtgtattggactctattgctccacgaaatgcctcagtgtaaatatcctatttacacagagacacattacccttatatatgcacagaaacacataggtataaacacacacacacacatatctttcatgtaaatgtctccatacaaaatgcatacacaaatcatactgcatagacacacacattgaagttactcaaaagctacctatacactctttgcagctaggttcataagtaactccctttcctatagccaataacctgcttcttttgtcattctcctttcttcctttgcatgctaattattgggattaaggagttagcacctcattcactgagttgatggtgttaattggtcgcatctgacttagttaaaagaaggcattttgactacaaagaacttcactgggagatgggcatagggcgagttattaaaagcaagtgcataacagctccttgggaggtcattattttgtgcttctccccccaccccccagaagtatgtttattattggtagcaaggtgagaagaaattccctgacttcattagaaacccagaaaaagaacttttatttgccaatatcttactttcttgctggaacacatttcttctggagggtgctatggcaaaatggcctggcccaagcatactttttgtctaaagggagcggtaacaaactccctggggcttcagggctcatcctagacaatactcccgccgctccccgcctccacactcacacacagcaaaacagccacctcattaactcaaagttggaagtaactcagacaccaccaaactacttgtattcacgtgtgcaccacctcagggaggggaaaagaaaagtttcacaaacatttgactagtatctattttatatgcatataaacaatgtgctcatcaaaaacctttatctgttcattgagccaggctggcagaacccagtgtgacatgccttggttggcggatactgtaacaccagatctatttggcattggtcaggaaggagatgtttgtaagtgcatgtcccaaataatagaagtgtcccttgcagtactaattgtttcaaacggataggtctctgtgttttcatgccaagtgaacctgacacaatttgccttcttcaggttgattccaggccatctttaaggacattaatcattgggtcgggctgagatgtgtagtgtctttaggagcaatcttgaggtgtatcagactgtttaattatccagtaaatggccgcaggctgttttttttttttttttttaagaactattctgtcttatatctaaagtttttacttactgataacattgtttatgcctccagtagtccattgacattttctcttctatcctaggctcagaaaataagctgagttacaattgtgtataaagtaggattgtgaaccttagggggtttttctacaagcactctggatgaggtttggggcagagattttgtatcatctcttttggctctcctaaggtctttaaaggttatttattagttttagctctgtgagtactagacaattatgatttccaggaaggggacctttagataagtaatatatcagtgtagttagggttagtatagataaagtaaaccttattaatttggacttcactagctcatgacaggggactgctttatttatagactaggctttggagtttaccattccaccagctacaaaaagaaaggatatgcttggtaaactaataccttaaacaaaattacaggggtaatataggtttcatttacatgtgaaacattgattatatttctctatttattaatattgatgccattaagccatctacttgataatacaattcattgtttatatttggaggtaacaatagcaaacaataacatctcaattaatcaatccattaagtaggaatttcatttgattaaagttagcctgagtacacagagacatagaagactaatggaagctctcagtccttgactagcagcagtggcagctgaagaaatgagacagcctagctagtttcttttaatggaggaagctaaaggtctgtagtatcttcagctcagcaataaccagtgtagggtcaaatcccaaggaaacagaagtacacttgcaaacttgagtgagccacaacctccccttggagtatggctggaattgagtattgtttctgatgttattctgtgaaggaagtttctgaataagaagagtcaatattaatagaggtgttactttataactttgaaagatatcctgacttttcagtaagtcaggctggtcttcccactgattaataatagataggctggtaccatgctaagtgtgttatatatatattatttcatttaatctctgtgaactttgcaggtggatattatttctatcacgtaggtaagaattcacttgactacattagtgaatgatcattaagtttcaagcccaattctaacttcagagcctgcttccttaaccactaccatatactgtaattactcaggagataggataacacaaatagtctagggtgctataataggtatgtgtcagcaactaagctgagacttggggtaaggggctctcccaaaccctacttacttaccctcgaagcccatacggaaatgaccttcaactagctcaggctgatataatgatgatgacaagatacatgaaagagaaagaacaatataggcatcttaatttctaaaataattatctttggggtcacatatacattgagttgttattcaatgttgggaactgtgaccaaggccaaactggaaacatgctttaactttcaggaacaaaactatcaaggtcagttaatcggtcttgcactagctagtattggtggtgaaatgcatgctagtttcatatcactgcaaaaatcaatggccattgtttagagcaaaatatcaatataaaatattgcataaaatgaatttgcaagttagatacttcatgtattaagagatgcttatgggggcatgaataatctcaagagcaaaaattgggactgctatgaaaggtttagggaaggtctccatgatgatgcatgactgggtcatctagtcatccacaggacagatggaaatattgaaaaggtcagagatttgcttcattaaatgtctttatgtcttgcaactgcgagaatgatgtctgaagaatccaatttggatgaagaagctgacttgatctggaagaaaccctaaacacaagcaaagtttctataaagatgtcaattcattttaagtgatgaatgaaaacagaaggtttgacatttgttttgaactttccagggaagctcaaaagaaaaagatgttcttgagtaaaatagtaaccagggaggaaaatggtttttctggtgtgattaagaaacaaaagtgttagaatcttcagaggcaaacttcggtctgccagagaccccaagataagcgcagaatccaactacagatgaggataatggagttgtgctatttttccaacaaccatggcactgtcatgtagaattcacctctcaaaggtagtcagactaataggatagacattctgaagcactggcagaattatgtggttgacttcttcaccaccacagtgttatgaatgatacatcacttgtgtaattttcattgtgcttaggccactcaataattcttgtgggttcggctctgtcctaggttcttggaacaatcatagtttggcacagaagaaatattagaaattcaggcttactctgaccttgtcatctcatgactttacttgggatcctacttaatttcctataactcttctagaacccaaatctcatatttggtcccccaattaacactcgagatccctgagagtaggattctggtttacctctctacaggtctttttaatccttacttgaatactatatttctatctgctcttgggtttcctggactccctctgcctatttcttgccttaacctctattattgccactgccatgtcaccctgacaatttgtcacctgcttgagcatgctccataatacttagacccatcttagagttagtatcacactgacttgtctgtttaactttcagatcctggccttctctgatttggcccaagggcctgaactgcacttaagaacttgtaactaaaactgatagttaaagaatctaacttagttgaatggtatgactcaacttagtctccaaagttatttattacagcaatctcggaaagactcttggctatttgtagcatgcaaatctattctcaaaagatgaaagttaacctcagctaagcaggaccaaaagtctgtgtcgaaggatctaaaaaatatactcgaaaagagtcccagtgttttttttaaaacatcagtggaaaaagtgtgtagtttcccagggaacttctgtgagaggaaaactctcatttggattataaattctgatggatttgtcacacaattattcctgtcactttgctattactgtgaaacagagtttgatatcagctttgttaaactccaatcttgaccatgcaaagagtattgagaccttatagtccccacgctgtatttgtgtcttcattcatatttatgccagcaataatcttgcactacagatgaagttggggatggaaggtaaacttgaggagcctgtagagcttgagaagaggaagaaacagattatgcattaaaatttagaaatcttggagaccctgccaggatactctgaatatagtttgcctctatttttggtttgtactacagttgacctatgcaccccactctgaatcccaattcatttggctgggatcctgatacctgcctaactcttggaagttccttcttcctcaggtcctggactctacctctaggtcctttctctggagttctacttctaggcacactactctgcaatttaattctagcttttctcctgaaaatgattagccctactgcccagagagccactttgcctttctccttcccagcctggccctttggtatagcaatgctaatacagacagtcccctgatgttgaggcagatactgttggcaactttcttttagaccaggcccaaaacccactttgccttttcttgtatcagacttgcctgttccaggtttcctctccctctttcctgagcagctgctgaggtactagcaagccatctggctgaaacagcagggttaaagtacaaattgaaactggagctcttctaatctagtatgacagtttgtactgatcaggttaatggggataatttctctttggcttgtacagagacatgaaaatttaatctgatctgctattaattactctgtccaatcattaacatagtgtttcactaaataaagaaaaatctattcacacggcagaggcaagcgttatcaaccaacgcacggtaatagaaaagtattgccttttgtgtccagcagggaagctgtgctaccactgtaagtaggacatgtactttgacacgtttctcaccattagggatggactgtcctaagccaaacaatctcttccagttccctctgggggattacacacatttgtgagatgatcggcaggggatactaaggtgcactgtggttttgggaacagagtgaaactaattggctcacaggaagattaaataatcacatctctagtgagagcaacaaaatgccctatcaaataaatgaaatgactctagatggctcttttcccttcttttattaacaagtatttattgaacaattattcagtgttaagtggctgtgctgggtgctgaggatgcaatattcaaacaaaactgacacaatcctacctttgcgaagtttctagtgcaagtaggggagaattatatatataatatatgtattatatatacacatatattatatatgtatatatgtgtacatatatacacatacatacatgtgtgtatatatgtatatatatagtcagataattatttgattgcagttgtgagaaatttataatgaaagagagtcagggtgctctaaaagtatatcataaagggactagatataccccaaaaattagccagatgaaaagtggggtgaggaaaaagaaaaaatagcatgtgtgaaggtactgacgaggcaagtgggtcaggaacttaaagccggggggggggaaagtttagagagcaagaaaaatgcaaaagatgagactggagatttaggcaagggtttatatctgtgtaggccatgaatggattatggatggactacatgtcattagagcttgtgacaggtaatcatggccacttccatggagcatttgggctttattttaaggacaatgggaagtcattgaaggtttctaggtttagttgatcttgggctagtagatatttttttaagtttcccaatggccaacacactaaacatacccctggacctgtttcagaaacctggactcaaaacgaaacaaaagacatgtatggatggagcaggtaaggcatttctactctgcatctgcacagaagtctaagcagaacccctgagaggctgaagagtaattacatttctactctggatctgtgtcttaaccacaaggagtgtgttctgcaggctctatttcataattgaaggtaattacagaagttaaaactagattagagacaattagaccctatacaacagggaactctgtgggtggtcaggaagggagtagggagaaccagctgggaaagtgtttccccaagtacttggcatcctttgactcattgtaagcagaggtttttgaggtgtctgttaatgcttctggtgcctttttacaatttgagagtgttggccggtgaagtgaagtaaacacatgcacacacacacacacacacacacacacacacacatcactgacaaccagtcaagattacctttttcctcaagccatagggcttcataggccaagagccaataaatagaagcaaaggggaaaaaaatgtaaggattgcatacaattaacttatttgagcaactgttttttgtcctgttctggatctagagactgtgggggaggcatggtaagcatatgatcttgcctttaaggtgcttccatgtgtatttgagaagtttgatatggctggagaatatatcaaagtgggagaaggggaatggtgaggggtgggctcaagagatgtccagaggccaggctaaggagctccgactccatccaggagcactggggaaccaaggaggatgataaacagggaaaggacaggatcgtgtttggactccagaaagatccatctggccactgtggggtgggtagatggggagtgtggcaaggagcaaggttggggggctcagttgaagctgcttgtggagggaactgggggtgtctaagatcatgaggagaatggtggggaggagaggccagtgcagagagaaaaaggtgacttattttagtctctttattcagtacacacccattgctttgattagccattgattcatttaatcaacaaataattattttgcatctactctgtgtagagcaccatgctaggaaaagttaaaaggaattttatttcagtctgtgatggacctgattaagtgttcaagtgagtggaatagtcaataaccactctaggatgttagagacagttctgatcagtgatgaaagtggatgatctcagaaacaacagaaggtgaagtgtagcagttggaatgcacatgaacactgagaagcacagtgaagggcgctgctagacagaagctaagagggtgtaataggaaggactggaggataagggatgggtagggtatagcgactatgtgtgtatgtaggtatgtttggggagtgtgtgtgtatacacatggacacaagtatataatgcaaccagaaaaccttaggaccaacaaatatttctataacgtgcgtacccacacacacatgcatgcacggaggtggagagagagagagagagagagagagagaaagagagagagagagagaatgagagaattttgtgccatgtagctgttgctacaagcttgattctttctaatttccccttaaaaggcatctatacatggtggtgtagcctgatggagtcacatttgttttggtaaatttactctttccatgcagggttaaactttaagatcccaagagcattcggctgtagaacctgaaggagggcgcttgctttggtcatttcccctggaataagggagcagcagtggtctgaacccctaagtactcagcctactacctggcctccttcagagaagcacaggctgctgggaacagggactccctggggatgacgagcgcccactgactcatgagcctcctcgcaacctttttaatgtccttgcttttcaagctgtagacgatgggattgatcatggggttgagcacaatggaagctcaaggaagaagacactaaacacaaagaagtacatgggggtttggagatttcagtcaatgaaaatgactctaaagatgagaatgttccccagcaaggcaactatatagattcccagaaatatcctcaaaatgaaaaactgtaacccatggagactcccaaatcccagaaggagaaatcctcctttaggtcctaaagtgcaatgctcttgggatcttcaggtttatccctgtgtggtaagattaagttttctttgatcatggtcagattagtcatatctgtgagattcaggcatcagatgtgagaaaagaaaacaattctagctaattagaaaaagagttatgctaccaaaggagagcaatggcaccagaaatgccatctagcacatacctcaaaggctctgttttttctcccctggaatacattttctgttttgttctactaggtgtatttacctaatagtcatagaggaatccaaaagtatgccctggagactgaacagaaagggcgtttcctctgctcttttctactatttcccttgacataaccggtgatgaatctacctttgggagtttcacagtgggaggcaagcactacttaatggggacatggtgcagaagcttctctgaacttaatattgcccgaacttctgaaactcagcttttaagactcaatagaaatgtgagtacaaatcccaaaataacgtcagaattcagaccaccctatctcccactgaaaccctgaatcagggtgggtttcaccaggaacataattggagggaggagggggattcagaactattgatcttaaagtatctgtaagaaaaacaagagtttcttccaggctctggggatatgtggctgatcgcttccatggcatcaaattcctatggaaattgggggaaaatgtatgtaaagttattcacttgaaatgttagagaaaaataatgttccatccttcataaatgaaaatgacattcctgactcacaagcagtaggatgtgcatttagagttatttttcttttctagcagtgatgatgggttagagtgagtcatggatgtagcctccccttccccacatgccgccccgtggtgcccaaagacccatatttgtgaaatgactgtctggtcttagtggctgggctgtgatgggatttgagatcagtctgccctgtgacctaaattagaggtaactgtgaggcctgagttagcagcttaggtcaattggtgttctaggctgaaggctcagtctgtagccagggaatatagccaagccatctttgttgctttgttttgggtaatggcaaagtgtccctaaaagcttacagagaaatcatattttagtaaatgcaatcctattttaaatccacttagggaactggctattcaaaggaatgttattaagaatgcttctgtgatgtgaaataatgtcttcataatttacccttttcatcaatctgtattgttaatacactgcacatgtgtaagggcaagtccacctatagttgggggatccaggacatcgtggctgcctaaggtagtactgattatgattacagcgtgtaaagaaaatcaatcagcattcagggttatccctgggggtaacagctgctttctaattgggggattaaactgcagtgtcctcttaccattttaccttgtcttcagagactgccagccagtattcagaactgacattaacattgttagatttgtatcattcaatcccaagtctccttaattagtaatggaataaacttcactttcccttttggcttataggcatgctccttggtacctccaaagtcagaggcacatcagcctcccttaatcccttcccatcttctcttttcttgaagtgaggagaagttaatgtagacgcaaaagagaggcttcagctcagggctctattcattctttcattccttcatttattcacttaccacacctttggacatatactttgtatcacctgttgagctaagtaggcactgggggaataaaaccatgaacaaggaaagcatggccccaacgttcctagagtttacattctagtggtagagggagatatttaacatatgattttacaaataatggtgacattactattgtgatcaatgctatgagggagaaatatagggtcctgatacaaagaataatatgcatggagaggtgacctagtttctgtgagttggtctgaaaaggaagtcatattaaaatacagtagtccaggtaagagatgatggcttaaatcaagcttggatgcagtaagatggattaattttaggtctttttacatagtagcattgatatttctttgtgtacttttctgtatatatattatacattaattaaaagtttactctaacaaaataacatagaatgttgatgaattgcattaggagagagcatgaggcacaagaaggaattaaggatgaatcccaggatttggtttaaccaactgcacagatgattatgtctgttcctgaggtgggaagaccaagtaggtaatttagttggcagtgtggagagggggatatatttttttcttttcctttccttcttttcttcccttttatcagatctagtgggttatgatccatttgtgggatgacagtttcaattctcatatggatcagtaaactgttgacagacacagctgtggccctgagaggcagggctctcaccgtggccacaaaacaagctcttaaaaaaagtctcacaaattcttgcccttggtctcaaaagggaagagagtgaataggtcaatgtaccctttacttgctcaaagcccagggttagtgattccatgtcagggatatctctttgcatgtgaagcatgggagatcacatttcaatgtggactgttagactccctttgacatgagtctccagaaaaccttccttaatcgcagtgccactacccaacaatttccattatctgaggcctaaaaaaattgttttgtttcattttgcttttgtgtgagacagatgacaaaaaaaagagctcagtcaaaaaaacaattttcagaggatgtcctggggtcagaatacattcagtcctactctttctctctcctccatcttcatttacagttccggccaatcagaattaatgctcaaaatgatggctggaggttctaaaagatcctcaatcagtaaagagtgattcaagtacatcattatactcgatttactaagtagggacagtagactccgatatcttaacagaatttttaaaagcaaagacaatggaaaacatctttgttcttaacctccagttacccagaaaatctaatcaaccatatcccctttacatctttcttctgatattcccttaatcaggatttgtctcagtactaattctcttacatcgttttgatcaccagaagctatgcattagcatgaaaagctgtttggtggacatataaagtacccccctccagagttcatacccccacccccaagatgttaataattacagaaatatgataaaatggaaagtgtagcagcctaagtagggagagagagactagctatagaagctgaaactgattaccttttctaaagtcaatccaggaaaacctcttggaaagaagggcagtgaggaggaatccaaagaacagttgaaagttggatgctggaagggggaaaagtacggctagacaaggagagtgatgatctggctgtaccagtcaggtacccagtgatctccctcccaacctccacctctattcattaaaacaaaagataagtaacaaatacataacactcaagtatgctcttggatctttatcctccccaaagtgcaaatggctgctatcaggggcaattgtttaataataaagatcaggggtagctggtaaatacagaagatcatcttgatagcccaagtctcactatttagttcaactcttggtccaaatatgtattgccctgtttctgaaagtgctgagagaaattaagctggcgagcaggcaaactacccagagatagagactgaaagggcagagaagagaagacacctttgactggtactatactagcgctcctaaaaaagaggaagttgattttgttggtcaactctctctaaaagtagtgcttttcttgaataattcaattttgtgccatgcagcaggaaaatttggtggaaagtttctttttttcctgtgaaaacaacttgtggaagataatagacagctcactttttaaaggaattgtacattaatgcaagaagccccctggtgtccaggggaatgattctgttatttgtgtttttgcaccttgagacctggagacaggcattattgagacctggagacaggcatttctgagatgcctcagacaaatattattgagacccagaaatagaccggaagataggcattattgagacttggtgacagatatttctaattcaactatattcttttgtgccaaatacattttttcctgttctgttccatttgtcaacacgacagacaatgaaacaggccaggaaatattttgagccaaatgatttgtgatgtgtcattatgtgacatacctagcctaaatgtgaagaatgacaacaattatccaggtaagttgtgcaaagaataacgaactcatacttttggtcccaactttcaagatatttcacataaaaattttgggagtctaaataacctagataaaaacctaaagtttgtcatttaacctacaaatatagaccaattatggctgttatgttatagcaaaacatctgaaattgatggaattcaaagaacattcagtcaatagaaattctagaaaaaaaaccacttggcctttacaatgcctcatactcagcttgaatgagtttactttctaatcagttatatttttctaatcggcttcttctgttcatcttgctctctggggaaaaaattgcatttgctagattttctatgcctgctccattcccttatagctaggagaactggaacatcctgatctatcattctaatacttacttgctcataccctcatggtgctagccctctgaatagtggggacatttatttgcttgcatccttcactctttgtcctggtgttggatgatagaaaaaaacctgagtacctctcctacttgctgctctctaatctctaccccatagcattcacgggctttatctatcaccactcatcatttctttttgaagctccctgctcctatactcccattctctgatgatgacaaattttacagttgttagcaagctgccatagtcataggaacatggtaacttcggtctgtactagagaatttatcatatcatggggaagtagtatattgtagtagttaagagcataggctttcatgtcagacagtcctgagttcaagttctgactctgccatgtaccatgtgactctggacaaggaactaaacctcttggtgtttcaattctctcagttgtaacatgcagaatacttatgacaacaaaactactgcatacctcatagtgttttatttaggattgaatgaaataatctgtaaaaagtgttggcaaggtgccagcactccataagtgctcaatctcattctcattttgcaatgtggcgcgtatgtataccattacttttaagttgtttcttgtgtcgtcgccctcaaaaaattgtaagtgcctcaaaagctaagtgcaatctcacaatttttctattgttttcccctgattttctccacatgtctaacacaagaggtgaatgcccagtaggagcttagtaaatgtttattggtatcaccttttccccatcccagctaaaatctgcaagctctattttggtcactactgacagaaatccagagagatttttcttacctctcattgtccttttcttccctagaaggactggccaccatgtcctcatgatctggctgcttcgttcatcctgacagagagtcaggacccaccttccagagcattctcagtctagctgcttctctaactgcccaacttaatatcctgccttaacttcctcccattagggagtcaggtcctgcctctttgctcaatatgtttttctcatgaaaatcaatttccctgaagcctgtttcccaagggtaatatttccccctcccctgggaaagtcaaacaaaacagttgagtatacaagagcatccagactgtcctgtgccaacaaatttctcaccaaaccccgagttctgaagtttgtgggttcagaggagcaaattactactctgaaagccaaacttctctgccatggtaatgaacagggccaaccctcagcaacactggggtattgggaaagatttttctgcagctacatttcctctcgctttagcacattgcaccttagctaatactcatttcatactgtctctgaacccttttgccatctctccacctctaggtcagtactcctaggagttcctttcaaaatattatttcctctttaaaaatacacattgcagttaaatacacattgatttttaaggaactcacttaatataaaaccgaatataggcctgtggtggaaattttgcatatagtaggcactgaatagttgctgactaaacaaaataaagatctagaaatataattagttcctcctgagtatgttcagtaatgaatcaatagcaaacagaaagtgttttcaaacttacacctactcaccctcagctcaatactcctaggaggccccttcaaaatctcagcctacaatcaggctttgatttgtagttgtttcttgaacccataatgaatttgggattttttgaatgaggaggtacagagcctcattactgaactagctatgatggaagagtttactgaacaaattcatgttgtaaacaagaatgcaaggtgtcatacttaacctccctaagagaactgaacacacctcgtataaaccaatgttgctgattacaaattacttatgtctgttccataaagcaaatacctcagttctttgataacattttaaagctgttaatttaaattactgaatacactcaagaggaaaataattgcattttagattcccaacatattattcagtcagaaaatatttactgaatgtctactacatggataatatctcgctatggatatatcttgaattatataataagtgtgctctttaaaaagtatatacctttaaacttttgtaaaactgcttcaatttcaaatgcattagaggtgatttccaataaaagacgtcctgtaggaaattgtgaaagagtgaggaatgttttataaccacttctctgattcctatggctctgttttataaatttaaatttttaagattttctcaaagcgagtcatccctgtaatttaaattggcctttatcccaattactttaatttggtaatgtggaactctggatttcagatagcatcagggaaacatacacctctacacctctaaaatctctttggtaagacaaattcagaaagcacgcttcctttttgtctagtacagtatgacctttttctctaaggaaggtcttagaagcaaaagctggcttcattcttcttagaatgcatccttagggagttcactagatgtatttttagggcctttcccatatatatgtttcttagggtaaaagcgagggatttcaatctggggggtgatcacacggtagaaaagacaggctgtagggttcccagtgatgcttcccccacaaaagacccaattcagaggtgactgagcaggtagagaaagcaataggacttccattgatgtgggggatcacagaatgaggatagcagtgtggatatttgataccagagactatagcaaagggctcacatccactgtgcaagtgctaagaaaaagggactcctctggagaacaggtattgatttaaacaggagtagtagtggagtggagtggagagagcacattctttaaagtcggaaagaactcatgaaatcacaacttggcctcttatagttggatgaccttgggcaaaattgcttaagttcagtggacttcagctaccacatttgtaaaatgggaacaatacctacctcattgggttgttgtgtggtttcaatgcaagtgccttgtgtgcaaagtgcctgctaaaatagatgctcaataaatattagttccctctctcctctcctctttcatttttttttatgaaagaaaatgatgatcgcttcatttactgcagagaatggcagctggaatgccagcgtgatgttgtgattaggatacaggaactgagaatcaagacttcttgccaagtgacatgtaaaattcaaagttcatagaagccttatttactaggctatacatttcttgggggcaaagggctgagtctatctcatttctctctgtattcacacagttcgctgaatggtagaaaatccagaggacaccaatcaagcttacaggtgatctcacatggggatatctctgcacttagcagaacttatttaggagaagccaaggaaagaaactttgaaaattggatcactagttctcaaagtttagttgtacactaaaagcaaagttcaggctagacaatcttcaagagctaaagaatgttattgatagagagtggtgattggtatctgagcaggctagtaagtgccattacataaaggagtctaatttcctgctctgtatttttatcacaggttccagatggagaattggatcataagtttaatgaacccctctcataagaatttgtagtagataggagggtggttttcatcaaagcttaagtggtaaggacaaagggacaagatctgaggttgtcataggaacctctttcccctcaagggccatcagcaggattaaataatgatcatggttcacactggcaagactaacgaccaggcagtcgggtgaggaacaagatggcaaagaaaatgagtgggagtaggagatgggggaagaaagaaaggaaagaaaatggtgttaatgctacgactagcacttttaatcactcaatagtcatgctttatcaatctcagaaccctctatattttctctttttaccacttaggcatgtagcctccagtcaggcaatggctatttactaagtgcctattccataccacgtactgtgataggtgctgtggtgatatagacatgatcagaacatggttagactgcaaaggagctttaggtctggcacagaaggtgatcgctttatgccagggtgggatgaaaaatgccaagagaggggttcaagcaaagtgctagaattagaagtagagaaggcttccttgagaaggtaacacttgaggtgttccttgaagggtgcaaaggacttcagtaggtgtgattggaagaagatattcaaggcagaaagaatgactaagcaaagagatggaagagtaggataaaatgatagtaaacttctttttctgttttctgtgcaccaggcacggtggcgagcactctagatgcaatacctcatttcatccttataataaacctatgaggttaataatattccattattatccctattttatagatgaggaaactgaggccagagaggctgtataaatttccaatgttgcacaattataaagtggcagagccaggtttttaactcaagcctatctgagcccaaagcctatgcatacaattaaccaatacactaattgcgaatcaggttatggaaaggagtgaaagcatagtgtgtctacagcacagagcccatggaaaggaggaaagggagaggagaatagaaatgtagctgcagccaaactgtggggcctctttcctggcagcctaaggggtggggctggatcttttaaacaatgggaaatcataggaagttttaaagtagtggagtgacagtaagagtggtgctttaggaagattaatctgtcagcagtgcagaggatggatgggagagcggagtgattggaggcagttaagaggctattacaatacaatagtccaagcgtaaggtagggtacacccttttcttgagctaagaaatccaaagtggtgaacagacagaggagagacattgtgaaggaaaaagaaaaagaagtccatgactaactagatggggagaggggagtggtggtgagggattggtagggataaaaattaaataaggaaactgaggtttggagcctttctgactagaagaatagtgatgccagtcacaaagttgagggatggctaccctggagagaagtttcaacttaagaatgaaactgggataaatctctaaaggtgatctttgcaataatagaaatgaatgggatccgcttgagaagagaacagtcaagggcaaaagcttgggggatgcctccaccgaggaggtatggctaggagggatagttagtaatggggataggcaaaagaggtcatggggtaaggcgaagaaacaggaaatcatgagaaagaggtttctagaaggttgagtgatgaacaatgttaatatagtagaggggtcagagagaaagaaggatgcaaagatactgttgaatttggtaattagaagatctttcctgaattaccaggagcagtttcaggatagagccagatttcagggagtgaagaaggaaaagagtaggggtgacaaattggagacagtgactctaaaaaattctcaggagaatttttgtggtgaaattaaggagcaaaacagatacttaaagtgtgctcaagtattgaaagatgatctcagggtaaggatgaccttagcacagctaaaggaaaatgtttgttaactaacatttgttagtgaagatgtcgagattaaagacgtgtggtgaggtcagaggtgactgtggctggaacaagattctgctgaaggcgagaagggatagggtcatgtgccaggtggaatgtttgttttggcaagtatggtggtggtatcgtccttggaaaatacaaagagacaaaagaggccaactaaagatacagaaatatttggagatggagagagggcattaaactagaagcattctgcattttcaaagaagtttgtgcaccgtgcactggctggtcttggtgttaccagtagattatctgtagaatggaaggcaagtggacatgggactgagaacttcaagagtgtgtgtctccctcaattgatacagtacctggcacacaaaaggtgttcaataagtattatttggaatacataaacaaacaagatctacaaaagtcactaagagacacaaactacgatgtcatagaaagtgaatttaaaaattgcagaacaacattcactggaatggttaagatgagaaagaaatgataccatagttggcgaagacgtgccacaagtggaatgtctgtacactgctagtgagagagtaaatggatacagccactttgaaaaactttggcaagccttatctactaaagctaaacatatgcatgcttcatgatctagcaattccactcctagatatatatccaagatgaatgagtgttttggttcaccaaaagacatgagcaagaatgtccataccaggacatagaaattaatgcatcataaagtttaaatggcctgcttgagtccactcaggttataaatggtaagtctgatacttgaactctgggctttcttgccacaagtttttattcaaatacctccaaaggctactggatactgtttatatagtcagaactttacatacgttgttgctaatctgcccagtcttgcagtatgtatattattgctctcattttacagattaataaactgagggccagagaatgcttactcaaagtcacttgccccaaatggtgggtatatatatttcttgagaactgagatgtgaacttagttttacctggctccaaaagctatgctttttctctcccatcaaggagtggaggcttttcttatgttttggcaagttgcaagaaggaagtatggtgggctgaggtagttgaaatcataagaagagttcagtgaaagaatcctgtcttgcctgtcttcgctgccagtaaaaccaaagccacagccaggtaatgtcctcccccagttttcctctgtgacccactcacattattgttaagggcctgggagacaaggatgactctaggcatagtgatgaagtagtaaacactcatcttctttgtcattcatcttacctattgtaggcaacctattaacacgtatatttaacagacacatgcatacacacatttgcatgtacacatgcacacacctgtaaagctatttccttaacaatctaacttttctaactccagaagaattattaaatactcaaagaagtgtttatttttgaggtgacttaagctatccattgcaggaatacagatcaagaacactccccattcacttgggttcctgttctaattcccttctcacagcgggtgttctgagatgtgtggcaattatctcaggctctaggttttcctcatgctaagagtatcagaacacccctaattcctccacatcctaatattttcttcctaaagagccccctgcctgaccttgaatcattcatctttaataaaagcaatcctgaggtaagagatcctagccaaggtggactgagccctaaaagacaagttttgaggtcgccaagttgggtgtagaagctctgacctttgccaggtctttccttactcccaaacaagaaccttgcagtacaagcccaattgctctctctgtcccttccctccctgaagtcaggtgtctcaggctcagaatatgagaattagttgtcatggtaacctgtgactgtgcctgatagcctcttctcttctctcagccagttctaggacctggacatctgttctcagttcacctcttctaatgttcctaaatctaagcccaggactatatgccaagttacacagtttctgtgtgaggtggtgaagaggccttcccctgcatccaaggcaagagaaacaagaaagagagaatggagtaataggaaacagtgctttaaagaagctatcagggaacagggaggccagggctactaattaaagttaatatatacacctactatgtacccacaaaaattaaaaattaaacaattctttaaaaagttaattaagcacttactatctgccagtcacggtaatgtcttgtccattatttcactgatttctctcaaatgaccttatgaaataagtattattatccccactatacagatgaaggaaatggaaactcagaaaggcaaatggacttgcctaacattgcacagctatgatttccacttggtccttatccaagtttccaaaacccagtctctttggattacactagtttatggttcatcatttcttggaaggaaaataagagctgcagacaagtctttcctcagcccctgtgcctgtgaatccctcacagcctttccccaggaatagatcccccacttcaaatgcagcccctcctcagacaccttctcctccatagactccttccttcctcttaagtcacctctttctattctcctgaggctctctacaattgccctctggccaaatccttgcttttcccactttctctggtagatccctgaccttttctttcctaaggtatatctttaatggcatgtcaaggagagtagggtaggccaatttcctgacacaggcggaacaaaggacatctgtattagtttcctgttgctgctacaacaaattgccaaaaatttagtagttgaaagcaatataatttgttctcttccagttctgcaggccagaagtctgaaatcagtttcactgggctgaagtccaagtgtcagcatggctgttctccctctagagactctggagccacctttttctgcttttggagctgcattccttatattccttggctcacagccctttcctttatcttcaaggacagcagtatagcatcttcaagtacttctttgcttctgtcaagccttttcctccgttctcaaatttccctttgcccccctctttaaggactcctgtgactacatctatggcccgcccaaataatccagggtaatctccccattgcaaaatcgttaacataatcacatctgcaaagcctcttttgccatataaggtaacattaagaggttccagggattcaaacccagagatctttgggggcattgttcagcctacacagcatccaaaaaacacaattttagtcttgcactggggaccagttgtccttcatttctggaatggatgaaccaggagctcaggagttagggtaaaaggaataagcatggattaagttaagagagttatataaacttgaattttgctgaaatgaatccaggtagggcaggtgatttctgagagagggctctttacttacacactgcccctccagagagaggtggaaaggaaggtaggactgagaggtgaaagattcttatcttctcctttccaaaacagttgccttatttgttcttctctttcctgggtggtttcactgggcagagaacagttgagaaaagggtgacactctggctccagagacaaaatgaagaagctagaacgtctctatagctgacctctcttctccctttccacctctatatttagtctcctctttccccgtccttgttgtcaaccagatgcttcctgcttgttgagaagtgaagctacaatgaagtgaagcgtggagtaatgaatagtgagtgaagaagaggaggaagtttctttaggagaagccctcatgtcagcccacttcaggccagagaaaagcctcctccagcaggcagtcttagggaggtgtggaatttgggatagctgccaagtagagtgaccaagagttacagggtcactccttgataaccattcacttctcttccttggtactgaacattgctatctagtatatggggatcttcaaaagtccctttccacaagtttctctgcatgatgattaccttaaggaacaattttaatcacacctggcagatctgggctaaagcctggcaaaactagtggagaatgggaatttggggagctcagattttgaaaaccatagaaagactggttgggatggaagtgtgggggcatgcctgatccgggactaaattttcatggtcttggagtgtcaacagcagcatcacaaactcagtgaggttttgatttatgagcaccagatgcagagttgtgaactgacgatttttgtagagttagcagctggctccccatattttgtttctgttccaggacatcatctattatgttgctcaatgctcctccttatataaaaactcataacaaattcttctccaagtttagggccaggaaaaagtttgtttctcctagtgaatgtgtcttctttcttctgccagacaatgaaagtaataaaaaggcaccccactccacacccaagccagagggttgacttaaactctccagctgtatgagttttgagtctgccgagggaaggagtatcacaggtgatgaggaagccagagggagcactcagaactcactcaaaattgggtaagcagggcaggccacaacttcagaaaggaaagactggtcacccacatgccaagaccaaatggggaatccagagaattcccaggcaatgatgacggcaccaacaaattccaggctgaaccacattagggagttttctagcagaaaattaggagcaagtcctggcttctagggctagaaaaagccaggaacatgtgggaaacagatctcagacagatcttcctctcaaggagggtgaagaaactctgggaactggtggcactcaggcagaaaaagggcctagttgtccgtgggatgtccagaaaagtctctggatctgatagctctacagaagtacactgatccatctgcaacagggttcaggaagtatttgactttctaaatcccactaacttaaatgaccagttcaattatacattcctgcaaccctttttaattgaccatgagacaaatgggtcacatcttacagaaatctgtatgaagaccagcatgaatggtattatcacaagacaaatgtaaacatcatgttttgattttcacctttgttgctaggaaactcacctctaaattgtatgctttattgaacactctagaagcataatggggtgagggtggggtcaatatattttgtcaccatctccttccatttgcactgcttttattctttgttaacagattttagtctaattgcaccaagaattaaccagttgtaagccccctcaaattcgttttgaaagtagacaggcagtaaataatcatacagatatatgatattttctttgtaggcttgtcaaatttttcatatgccctttcttgggtttaatgtgagaggactattgaccttgccttaagctatgctcacctttgttcttcagatttgttgctattggccacaagggggtctgggccagtgtatgtcctgctagcagtcgaaggagtcattgctacaaagtaaagaaagtacctcattttgctagatgcttttattacccttggcaccacaataacagtttcctcaggtttcttgtcttgggaacacctaatggcaagatgctcttgatacttcagtaactaaagctcctttaatgggatccatgatggacctgccttgttttgttttatagtgaaaaatgttttaaggaagttgcagtatatattttgttggtaaagatgccttaagctattaaggccatttgttattttctgaaagcaagagagataatgctccctaataaaattcactgcactgcaggtagctctacgtttgtttcctacaaagtgctccatagctcttgtgggcctgtttctctctttcgtctttcttacgtccttataagatggtatgggggcacagcttttttagtgctgagcaattggactctgaatcccaaataagtcacaaataggagctggcttaatacaaatggcactacctctttgtagccctctcctctggccctggctcccctgtttgcttctccttgtttccagagtccagcctccttgggccactgattttggcatctccttgaagaccctcccctttattcctattccttgtccacgattcaggcgttgaagttcctcttaacccaatttctccccgaattgaaaatgcaaatgtgcctgctttattgtctgtatgtgttaagcttctacaagaggttttgtgctaagcacaatgttctgtatggggaagtacaagaaggtgggggtgaagggagcagaatggtctctgaactgccactggtcagcagctagagtgctttgcacccttcaggcctgcgattggagtgaggacagcagaagaggtggatcagggcagacagaaccaggaagaagtactgtgggtattttatcatggagccagggtaagttgaactgaagaactgacagacagtcatctcagggagaggaaacagaaatttctctctcatcccaaatctctgggcacaaaattgtctttacaattatactgttaaaaggacatcagctcccaggaaggggagaaaagcacaaaatggggtggcaagggagaaaggctgtgggtttcacatctcccttccagaccaaatccaagacatcaggaaaatatacttttccccaaatgcaatgctatatgatgttacacacaaagatccgaggtcagttctacatgggtagaattcgcagacaactctgtgtgctaatagttcccctgtaatactaattgaagatgtttatttttctagcttctatttttaaaagccactgaaagtttaataatataaaggtttcaactttgacatctaatggactaaacccatgttagagggctgaaattttataatcaccatctgatgggactcaagagtattaaaaacagaggtttatacgggagcaggcagggatggtggcggtatgcagtccatggatcaacaactggcttcttttaacaaaaacataaaagctatttccagctgaaattctcagaaacactataggaaattaatataactgattgatgtgatctcatctaatagaactgggagttgaagctttatccctctagaacaggtgattagaggcaaatgaggggcaggttcccatggcaaccatttggctatctcagacccgaaggaggcctctgaaacagaagctttgagaaggaatatggattttcaaagggaaaaaatattagacatttgtcttttagggctatgctggagtgcataggggattaaggtggtgtgagggcatatctagagttgttctgtgagtgctagggacagattttagatactgttccagtcccttgaagctgaagaatcactgctttgtttggttacttctctctctacaaccttctgccaagggagacagtacagaaaaggatcagagtgtccatggacattcctgtgagcctgcttgggccatggtgggtgtgagtgtcaggtgaatccagcatgcccttcccttcacaaatatctcctctcctccttgaactatttcaatcaaacattctagcctgtgatgggactaaatgaatctttagggtggcagtgctgtgctgagggaggagtagcagaatatcaggcctctttgcatgaaggggtgtggctgaagctttctgttcactctctgttaggagattaaggttctgttttatggcagccaccagtggttaggggtacaagtcaaaaccaagggtcattgattgctcttcttattctgaggacttttccatcttcctctaattactcctaagccacagccattaccttaccagcctcactcttccttcctttcctccttagaagtgaagtattataaggtctcctgttattttctttccccagctatttgcacttttctgtggttccacctcctgcttctatctgcgccccccctcctcccacacacactccctaggcctttgctgacatctgagatgtcagatttgatgaaatatctgtttgcctgcccctggaatctcagaggccctataggattcctaatctaggccaacagtgccactgaaggatgaggatcagggatagatataacactttctaaattcctactatgtgttttcacatacactgatccatcaaatctacaaaatagcccagcagagtagacattttgttattcctgttctacagatgatgaaactgatacaagattcacatgacttgcctcagtgattagaacttgtaagtggcagaatcaggatttgaaccctggtcttctggcaaccaattctggtttttcttccactccattaggagaatgtgaggggtcgacatgttcccagggacagatgttactgtagtgtcctaaaggctgatggagaatgggaggggcatcttggaagactctgtttaactgttgtaaccccaggggctttaccttggttctcactcaaccagagaataattgcaagtaattcattctcagtctctcactggagaatacccagttctcaccataggctcttgaattacctgaaccaagagttctctccaccctggcattttgatttccattcaggtattcatctcttcattcacccattcattcattcactcattcattcatttgatcaacttaattgagtatctcttaggtgctagacactatgcaaagagttgaagatccattgatgatgcagccatagtccctacttttctgaaggattcagagacatcgataggaaatgataataaaacatagtaagagtagtgataaatttatggactgatttgcagcatggacactttgaccaaagttgggggtgagccagttgtgagggtttatctttgtaggaatcaatctctcctggctcccaggtacacccccagtcccccacattccttctccaggttcctatgagtagtaatactcaaagtcactattttttttaaattgggttgttgtgcaggaacagaaaaccaaacaccacatgttcttactagtaagtgagagctaaacaatgagaacacatgaacacagggaggggaataacacacactggggcctgttggtgggtgggggaaaggggagggagagcattaggacaaatacctaattcatgcagggcttaaaacctagatgatgggttgataggtgcagcaaaccaccatggcacatttatacctgtgtaacaaacctgcacgttcagcacgtgtatctcagaacttagagaaaaaaaaattaagatgggttgttgtttttggtggaagatggggagatatgttcatcatatgaatcatcagttggagtggagtctttcaagaaaaatataatgcacaaatactctttattgaatttctgggaaatattctaggaaattagcccacaaccaactaacgtaattccctctaacaggaatatgtccaatgaatctagagagcttagattgccttggtacataaagaagtaagtagaatgcattttttttattaacctgctttgtaaataaatgtccttgtatgagaacatgatctctgaatgctgtcttctacacgaccctcttcctgtgtcctctctaggagtgggtgcccatgtgcactgcagtgaccttttcttctctctagtcttctttgaaagcttgttttctctggttgtttttcttcgaacagacttgatatagaaattcacactgtggtgtgaatggataaaaacaacttaatactgtaccccttatgaggtatttgcattttaacgaagaccagccactcaatttggagacatacgttcttctttttaaatttccatcccaataatcaatctgtttttcagaaacttatgcacaaagtcccagattacaggtcttctagacttaaattctaatgggaacattgtaaatttgactcttcgggaaatattttaaatagtgggagctctttctcttccctaacaatttccaactctggcacagctgctcaatgtgaagtttgtaatttctccttccttcccagaagtacttttggctcagcttaatctattatgcctttgcagtcgccattgaatgcctctagtccatgcagagtggaattgagaactgaagttggacttccgtcatccttggggtatgaagataggataggaattgatccgattctggttggttgttgagacaagaataacttggcctctcctcatgtgtgagtactgtgggcagacaagctcatatgtcccctcacatgtgcatgtaaccgcatgtggtcttacacatatttgaggctaaggatattgtggggggattgctgaaagatgggcaataataaagactcagcatgtttcagacactgtgctaaaggagctatgtatcctcaaaacctttgtatgagataggtattattattaccattttaacgatgaagaaacagaatctcagatatgttaaataaattgcttaaaatcacaaagaaaatttaagagactgggatttgtacctcagtcttgatccacaacctatgctttaaaaaataatcactacaatatactactttgcataggagtaggtagatagatgaggtacagtattccaaactgaagagagatacaagcttgaacaatgtcctagaaataagaatggacaagatgtgctttagggacactaagtagcccagtccagtgtaaccagaggcaagagttcttgtagggcagtagaggaaagaattcctgcaacggttgtctggggtcatgttgtggagggtacaaatgttgatccaaagaatagcttctctctcctttatctagtatttcaattattaaggagctaaagaggttttcagaaagtataaatgaaaatattttcagaattatacagaggacttggagataagtgaaagactaaagtcctaacagaaacatatttaataaaagtaatcattcagcaccataaagcattagatgaagtctattgtgaattgttttccctgtgcacacacagagaaaacatccagtattgtgattaccaaggtaatttgtcttaaggttaatagatggttggagaaaatgatgttttgttgtgttccattctacaggggccaaaaggttctgtttggcctgtatagcatttacaaagaaggtactggtctaataatcccaaaatgacaatcccagtaacatcacaaaatgacttctattgttggatggaacaagtgggaatctaggtaataatggaaatggcttcctatgtggcactccctgacctgggagaccacaggcctggactccaattctagttctgccactaattaaccatgtgaccttgaaacagtcactcagttgctcttgagctcagttttctcacttataaaatgtgggagttgcaggagagtccctgcctgccttccttgtcactttttcttttgtgtttttaaaacgtatttttaaaaatttcacaagtattatgtggatcttttctcattgtaaaaatgttaaagaataccaaaatccccattcagctcccacttcatctctcttctgagatacaaattatatttgtagcatcattttccagacaattgttatgtatctgtagtcatatagatacatgtagtttctggggttattttaaaaatatatgatatcaaactgtgtgtattgttccacaagtcaatttttgtttccattgaacagcatgtcttggggatattttcatgtcagtacatataaatctatttcattctttttaactgctacatagtatgcatatacagtaccatcatttgtttagctatttttcactgataagtatttgtttacaaataatcatagcacagttctgcagtggacagccttgggcatctccttgtatgcatgtgcaagtgtttctttagggtatattatttgatgtggaattgctaggctttaacatttcagttttattccacactgtcaaattgctctctaaactactagtgccaatttacacacctgctggcagtttcattacaagttgatcaacactcgatatggtcagacattttcatttgccagtcttatggatgaagaaagttatctctggtaacttggaaaggtaaacgttttttcctatgtttcttatccatttgcatttcctgtttgctggtcagttgctcattatatcccttgtccattcattagaatggattgtttatatttttggtattgatatgaaggattatactttctatattcatataagtgcatatgtcaataactataaaattatatacaaattataattatgttatagaatacaatttcatttaactttgcttgtggcgaataccaaacagaacttaaaaattctcaattctgtcaaatttatctattttatatgatttctgcattttgagtcttgcttaaaaagtctttttcctctctgaaattatttctactatattttcttctaataacttatagttttgcttttttatagaactccttaatccactgggaatttatgtttattttgtgaggaagggatctccatctccagctgagtctatgtgtgtttacgtgtgtgtatacacatatatatgttttatatatacatgtatatttacatgtaatacatatttattcacaaatattcttaccaatcatgaaatgtcctaacatttactgaagcgtacatcatctccccactaattagagacacttctttattaatcatataatgaatttccttttatttacatggatctggtttatgatcctatgttctgtttcactgacctcgttggctattcctgtgtcaatactatattgtctgaataaactgtaagtttctaacatactttgatgtctgatagactaaatcattttttggtttccttttccaaaattgtcttgactattttcatacaatttcttttcttggtgaattttagaatcagcttcaaattctgtaaatattcctacctaggttttgattgtaattgaatttaatataaagaataatttggatagaaatgacatttctataacagtgattcatcccatccaggaacattataagtctcttgatttattaagttcttcttttaagaccttcagtaaagtttagaatttccttagacaggtctcgaatatgtcttcttaggtttattcaggcttgaatgtgttttattacatttcttcctaagtatttcattacatttttcctactgtgatttttttttcctgttacattttcaaatctgttgcttcatttattttattttttcaagaaatattacttgggtgcccacaatatgccagacattgtgtttggccctggggattaaaatggaacaaaacagactttttaaaatttctagtgagttttttttttatttatttggccttttctttctttttttttttctttttaaaattaactttatttattaattttttttttactatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatattccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgcagcaataaacatacgtgtgcatgtgtctttatagcagcatgatttatagtcctttgggtatatacccagtaatgggatggctgggtcaaatggtattgctagttctagatccctgaggaatcgccacactgacttccacaatggttgaactagtttacactcccaccaacagtgtaaaagtgttcttatttctccacatcctctccagcacctgttgtttcctgactttttaatgattgccattctaactggtgtgagatggtatctcattgtggatttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatgtgtttgagttcattgtagattctggatattagccctttttcagatgagtaggttgcgaaaattttctcccattttgtaggttgcctgttcactctgatggtagtttcttttgctgtgcagaagctctttagtttaattagatcccatttgtcaattttgtcttttgttgccattgcttttgatgttttggacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttagtaccagtaccatgctgttttggttactgtagccttgtagtatagtttgaagtcagatagtgtgatgcctccagctttgttcttttggcttaggattcccttggcgatgcgggctctttttttggttccataggaactttaaagtagttttttccaattctgtgaagaaagtcattggtagcttgatggggatggcattgaatctgtacattaccttgggcagtgtggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctcctgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaatagtagtagtgagagagggcatccctgtcttgtgccagttttcaacgggaatacttccagtttttgcccattcagtatgatattggctgtgggtttgtcatagatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctgttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactccttttggttggtaagctattgattattgccacaatttcagatcctgttattggtctattcagagattcaacttcttcctggtttagtcttgggagagtgtatgtgtcaaggaatttatccatttcttctagattttctagcttatttgcttagaggtagattttctagcttatttctctgatggtagtttttatttctgtgggatcagtagtgatatcccctttatcattttttattgtgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgcattctgctagcttttgaatgtgtttgctcttgcttttctagttcttttaattgtgatgttaggatgtcaattttggatctttcctgctttctcttgtgggcatttagtgctataaatttccctctacacactgctttgaatgcgtcccagagattctggtatgttgtgtcttttttctcgttggtttcaaagaacatctttatttctgccttcatttcgttatgtatccagtagtcattcaggagcaggttgttcagtttccatgtatttgagcagttttgagtgagattcttaatcctgagttctagtttgattgcactgtggtctgagagatagtttgttataatctctgttcttttacatttgctgaggagtgctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttttctcttttgatctttgttggttgaaagtctgttttatcagaaactaggattgcaacccctgcctttttttgttttccatgtgcttggtagatcttcctccatccttttattttgagcctatgtgtgtctctgcacgtgagatgggtttctgaatacagcgcactgatgggtcttgactctttatccaatttgccagtctgtgtcttttaattggagcatttagtccatttacatttaaagttaatattgttatgtgtgaatttgatcctgtcatgatgatgttagctggttattttgctcattagttgatgcagtttcttcctagtctcgatggtctttacattttggcatgattttgccgcggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggataggaaattctgggttgaaaattcttttctttaagaatgttgaatattggcccccactctcttctggcttgtagggtttctgccaagagatccactgttagtctgatgggcttccctttgagggtaacccgacctttctctctggctgcccttaacattttttccttcatttcaactttggtgaatctgacaattatgtgtcttggagttgctcttctcaaggaggatctttgtggcgttctctgtatttcctgaatctgaacgttggcctgccttgctagattggggaagttctcctggataatatcctgcagagtgttttccaacttggttccattctccccatcactttcaggtacaccagtcagacgtagatttggtcttttcacatagtcccatatttcttggaggctttgctcatttctttttattcttttttctctaaacttcccttctcgcttcatttcattcatttcatcttccatcgctgataccctttcttccagttgatcgcatcggctcctgaggcttctgcattcttcacgtagttcttgagccttggttttcagctccatcagctcctttaagcacttctctctattggttattctagttatacattcttctaaatttttttcaaagttttcaacttctttgcctttggtttgaatgtcctcccgtagttcagagtaatttgatcgtctgaagccttcttctctcagctcgtcaaagtcattctccatccagctttgttccgttgctggtgaggaactgcgttccttggaggaggagaggcgctctgcgttttagtgtttccagtttttctgttctgttttttccccatctttgtggttttatctacttctggtctttgatgatagtgatgtacagatgggcttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcaggggtcagggatcagggacccacttgaggaggcagtctgcccgttctcagatctccatctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggcttctttgtttacccaagcaagcctgggcaatggcgggcgcccctcccccagcctcgctgccgccttgcagtttgatctcagactgctgtgctagcaatcagcgaaactccgtgggcgtaggaccctccgagccaggtgcgggatataaactcgtggtgcgctgttttttaagccggtccgaaaagcgcaatattcaggtgggagtgacccgattttccaggtgcgtccatcacccctttctttgactcggaaagggaactccctgaccccttgcgcttcccaagtgaggcaatgcctcgccctgcttcggctcgcgcacggtgcgcgcacccactgacctgcgcccactgtctggcactccctagtgagatgaacctggtacctcagatggaaatgcagaaatcacccgtcttctgcgtcgctcacgctgggagctgtagaccggagctgttcctattcggccatcttggctcctccttatttggccttttcaaggtaaacagttatattgtctcttccttcccaatatttgtatttcttactttttgtctcactgaattggcttggacctctagtataatgctgaataaaaacaaagatagtgggaattttttgtttccgtagtttaggggaatttttcgtttccgtagtttaggggaatttttctgttccaccattaaatgtgatttttttgctgtagatttatagtagatatctttcacaaattaagaatatgttattcttttccaactttacctaacattaggaagatgctgttaattaggtctatgtaaaacactcatgtatgttcctgaagattcagctgaatctaaagtttcatgagatcactctagccaatgaatttccaatcattcagtgattgtgattatattaacatttatgcaaactgttttttaagaagtgatttttagcatgattctactcattcatgtttgtatgcatttgttaatcacagattcaaaagttctaagaatgaaaacatgctcaaattgtatatatgaactctgaggaacaacagaataaatgttaataaaactttagtggcgagatcaaataaactaaaatatagaaactaaacttcaaatcaataaaaaaaacaaaacattggaaaaatcaaagagtgaaaatccttaagattaattaacgggaagtatcagattcaaatttgtcagtgaggtgtaatcaacaacgaagcgcataacctgggaaaaatgtgttacaactgtaagctcagtctgctgactgaaaacagtaatgttttatcaatactaaaataagatctgctagaatggtgtatgttatgttgagaatagctagtttcatgaaataatttgaggcatctatttaggtgattatataatttctatattttagtatgttaatgtagtgaattacattaataaatcctctcatattaggtcatatttatttcatgggaaaagcctcattggtcatggctcatgatgtattttttaatatactgcggggttcaaattgcttatattctattgagcattctgaatctatctttgtaagtgatattggtcccatagttttcttttttctgttgtttgcccaaatttttggcatcacaattatgctagacttgcaaaatgagttgaaaatatttcgttgtttttctatgctccagaatacttctgagagcataagagtgatttgtttcttgaggatttgatagaatttgtctatttcaatttttgggccccatgccttgttttagggataaatctatgactacttttctgatttttggtcagttcagatgttctaccccttcttcagtcaattttagcaattcatgttctcctataaagtaattcattaagtactgattttcaaaattttatggtcataaaattatacataattacatttaatggaacattaaatatcttccacatatgtagttattttaactactgttctaagcattgttgacttatatcttctatctgttttccttgatcagacatccccataggtttagctattttagtagtcttttcaaatcaattgtttcagtttttatccatcagcactaccctttgttgtttgtttggttttgtacttgtcaatatttgtttaattcatgcttttatatttatgttcacttttactttctctgagttaaccttgttctttttctaacatcttgagtttctcataaatttatttaggctatgtattctttgagtgccattttggccatgctccataagttttgctgtacagtgctatcactcttgctcatttctaaatagtttgcaatgttaactttaatgtttttctttgacctggagccattgagaaggaatcgtttaataattatgtagaaattctttataattttttggttaaccattattgctaatttctagttgtgttaatatgtgttcagtgtatgcagccttaatgttttatgcttttctgaatttgctgagatttcctttgtaattttatacctagttatatatagtcaaattctgtgcatgtcccatatatgtttacagactaactattctctgcttgttggatgcattcatgtacatagctattgtatgaaactcatgaattttgttccccaaattctcttcatctttattcttgtttctacttgacctgttgtcaggtttctgagcgagaggtgtggcaattttttcattaatgttgtgggttgccatttcttcttgttttcttgttcatatttattttctttatttcaaaactgtgttcttatgaataatctaatgattggtgtatcttcctaatggattgtaccaatgcgaaatatcactcttgtccctttaaatttttgtcttgttttattttgccccacattaatatcgctacatctactttatttttgttggcattgtcatctgtttttctcagttcatttattttcaagtttcaagtgtcattttgtttaaagtgtgtctcttttaaacaggatgtgtttcaatctcgttatttgttcaatctgagattatcttttagtaaggagattcaacccattctggtttaatattattgttgatacttatgattatccctgccatcttattttaccttttctattatcatgattcttgttggttttctctttccagtaatttatgggattggtggtgtttccgtattttattttttgttctctagtagttttttggaaggtttatattatatttcgtattccagtggcaatgcttaatttcttcaaatttactcaaagatatattctgcatacatttctagaatttatgattatttatatacttatctgaaaaaggcaacaaccattgcaatattttaccttccttttttcttttctcttaaacctctcaagttttcatgttgagatcatctaggatttagtccatattgctactatttttttacaataataattatttagatttagttacagttttttacggtttcactgttcgccattgtttcttttactccacataatcccttcagattcagtttttattttgctagagtacatcctctaataattcactcaaagatgaataatggttggtgaaatatttgttcttgcatgtctgaaaaatattttccttttgcaacaaccctcagccttccaacttaaattttagtctttcttagtatagtattcttgcttccaaattattttttctcataaatttgaagctaatccattactatttctgaacatgagtattgctaatgagcaatcgatactagcctggttctctttcctgtgcaggtagcctgctcgttgctttggaaacttttacaaattttgttgtctttatccttggagttctcatatttcaccaatatgtgtcttaggtacagatatctttatattaaactatctttttcagtgactggtatgtgatttttatttgaagacttttgtctttcttcaactttgagaaatggtgtactgttatcgatgttttaggtcaatttccctttcaatttttctttgttcttctttaactcctagttactctgcttccttgggcattagtcctgattcgtgagtttggtgactccattttatggtgctggttttccccaaatgtttgtgaattttatgttagtgctcatcatgggttttgagaacctctgtttgcttctagatgacatttctgtttctcacagcctgcacactcatcaagattttgagaaaggacaggccatgctgctgagtggagtgtataagtagttcatcttctgggtatgaaggcttcctgtttctcctaggtgtggccaaccacttggtcttgcttctgcaacctgctttgcttttccagcccaagcatccaaaatactttttctagcctgagaaaccatctatgctgcccactacctgacacagttaggcagaggagaatgaataaaatcagtcagctgctcaaaatggggtaccctaataatgattttcctgtggcttccatataccacctgtttctcctgtctctgggttgggagatcatatggagtcatagcctccttattcagtcatcctctactacatatgttttaggctgtgcttttctccattaattttattccctttaccttttgactcaaaaggattcctcaaaatgtatgacaggcatatatatttcttatttttaatttctgttgtgaatatattaattttgaatatatattttctgtcatttatagagattaggggctggagaggaaagcagccatgtgagcctattctacctttagtcactttctacagggataggcctgctatagtcatactttctttctccttaattagggaaaaatctggaatacacgccgggcgtggtggctcacgcctgtaatcccagcactttgggaggccgaggtgggcagatcacgatgtcaggagtttgagaccagcctgaccaacatggtgaaacccatctctactaaaaatacaaaaaaaattagccgggtgtggtggcgcatgcctgtaatcccagctactcaggaggctgaggcaggagaatcgcttgaacccaggaagcagaggttgcagtgagccaagatcgcgccactgcactccagcctgggtgacagagcgagactctgtctcaaaaaacaaaaaaacaaaacaaacaaacaaacaaaaaacacctccaatacagaaacaactttatgggaagtacttcatacaaactatgaaattgtgagcaaagtctaacatcccataagatgatggtttgtgaggaatgccctgggcccaaagggagtgatcctaataggccataaaaaaaagaactacaatcacttttaaagtttgctcatgttaaaccatgaatccacatacagtgcagaatgtactaaattcttgaacaacattgtaggctgattgttttcatagaacattgacttaagatacctaagtttcaagctgggcatggtgacacatgcctgtagtcccagctactcaggtgcctgaagagggaagatcacttgaggccaggagtttgaggctatagggcattgtgatcatgcctgtgaatagtcactgaactacagcttgggcaatataccgagaccccatctctattaaaaataaataaatatatacacaagtacatagataaataaataaataaatgggcctatgtttaaagcttctgcttgaaagaataaagaaaaaggtagttttaaaatggaaagtcataaacatccaaatcttaaaaattcatgaatttagatcatattggaagtagtactggtcagatagtttggtggagatggagaaagagtgttttgcagtgtcagagtggcttcattaaacacaaagggagaagtgatttgcagctggaaatttcagattcaccataaaattaacatacatgcccgatgggttctcatctaataaaactgagagagagtgcttggtatcctaaaggcaaaacaacttaataaaattaatctatcgtgctcctagtgcttaggtactgcaaggcttcaatgatgcatttttcattaagtgactgggtaaatataattctctgtgttagaaagtctgagtccttattctaatttattgaaattagaaataaagaacttacttaatgactcatcagtgttgggaagacaaaggggagggcaccgttttatggtggcccctatgactagaagaggggtagtatgaatttttattgggcttgaaccaacaggactcttccgggactcatttattcttcccagacacctttgtcccaattttaggggctagacaaactccatactaccctcatttaaatcttctaatgtgcattgaactctctgcctttatgtaaggggcagactgagccaggaaaaaggagctaagctagagcctgacctttgtatttctgtcatgttttacagagtaatcccagcaagggaaagaactgactcagggcaggttcagcctagctagtgttatctttgtgtgtgttggaaggagcagagagggctaatgagaaggcatctgcttgggttgatgtgaaaagaaccctgggacaaaggtctcttatcccaaaagatatacctcacctgcctgcccctttcaccataggtttccaacatagttagtcattcagtcccttgaaaaaatagaagtcttcttttaacatgcaagcgctctcaggaggtataaattgttcatgtttcacaagtcctctcaagcgctggagtcaaataagactcatgcccccaattgtcacttatcttaggtaaattcttaatctgtcttagcctcagctaaaccatctgccaaatggagatgataatctctacctcaaaggttgttttgttaaatgaaaagcaaatgtgtaagtacccaagaaagtgcctgacatgcatcagatgtgtccttaccttctgtcacttgatctgtatcagtcaactgaggggggaggtggcaaaatggagtgtagaagtgggtcccaaagaatctagaggagtaggcccaggcaggaaaagcaaaatacagaaaggccaactctgactcagaattatgtccagggttggaatttctgtgcgtcaaagtgctgaaataacatgcagtagcagttcaagcctgctgttaagtagcactagcacgatggttcaaaagagggctttgtgactcagccttggttctcaacatagtggagaagaactctgcttatcatttatatgacactgggtaagttactaatttggctgagcctcaattacctcctctgtaaaattaagagtataatagtgctttccttagagttattgttaggcttaaatgtgttactatgcatacagtggctggcacaaagtaaatgttcagtaaatgtaacttgtcattagtattaccagtaactctactattactattattttatcttccagagttaataaattatttgtaagttccagagcacttagtcctaggaccagatttcagatgaatttgggagaaaactaaagatttttttctagtgttaccctacttcttatttcagagtctttttaggcctggtggcagccccccaccctaaagggttcagtgtcttattccctttctattatttgccttttcataagctctgccctcagagtttctggagggaagactccaacacgaattcttgctattatatgaatgggtgttaactcaaatcctgcaccttccattgaatttacacttttaataaaggcagtctcttaatttcagagaccattagttattttattcccttcaactccagggatagattagcaataaacaagtggctcatgtacagacttttatggtcaatttttcatacaaactagtaaatgaaaaacagcttgtgatggaagaagctcagaccaacttgatcagggcatgtgaggaatgacttgggcccagagagagagattctaataaaccaggaaaatgactttcttaacccccattgttcattgacgtcaagtccaaaatgcacaagcctgggtgctgagcaggcttgcaagtttacttgtcagaccaatttaagacccttgacatttgggtttctttttagccaggcaaaataggggagaaggaattttacaatatatattttaaaacatcaaatcagaaggatgctgagattcatcttggcatttttattttaccatttgcttccccaaagtacttttaatcgggtgaatgttaagtttggggtcagtagaggacgagaaggcatgttgggcaccagaatcaactattagattttttttaaaaggaaaacataatatccaaatgctctttcaagctacaattctcggagatactccaaagaaaatagcgcttaattggctcatgtgatcttccctaagtagttatctacaaatatatccaataggtccagaaagtttagactgctgaggctgagaagaggtgagtgggatgatgtattttgtgattaagcagcttggtatattaaagtgtcattgttagaacatgagttgtaagtgctcttctccatgcgcccctctcactccttgttccccagtgatccctcttgtgcccctggatggtctttacttctttctggccttcgtctcaaaacttgtttttatagacgcgcgcgcgcgtgtgtgtgtgtgtgcacacttgcatttgcattgaatcggacaacaaaaattcccactgtgatgtgaacgaataaaaaaacccagctcaacaagatatttgcattttaataaagaatataaagtcctaaagatagaatttcaggcactagtaattatggagtaaggggcttcttggccagatggagctttattatgtttctttttaccatgtgcctgcaatatttaattaggctctactcacatctatctggcctttgtaatcatctggcttgcataagaagttataggtagcaggcagtagctgatgtgaagagacccactgggttagcagtagacttagcaaaatgtggcacatataggctactaattttatttaagtaggctttgttcaccaacagaggaagttgaaacagtatctggcattcattccacattctggcattctataatagcaagtgctatcatgtatcaagcacagtgttaaatgttgagctccaatcagtaataagatatggttattttcttggaagaactcagagtccagtgggaaagacaagtaaacattaaaaaatacaaagtgattggacaactggctagctacttgaataaaatatctggatcccaagtgactcttcaccgaaataaattctggattgatcaacaatttcaatattaaaagatggaaaaaccataaggtactaaatgaaaacatggtgatttcttttataatcttgcaatgaaagaaacctttctaagtaagcatgctacaaaaactgaatatatatatatatataggaaaaatttgatacagttgactacataaatactatcatttctgtatggcagtaataaataattaagcaagtcaaaaggcaaatgacaaactaagaaaaaaatatgtattacaaaaatgacaacagactactttaaaaaatatacctgaagcatttacaattcatgaagggaaaagactagaaattggataaggaatcttaacagaaaaagaaatataaatacccaatggatataaaaattctgctcaaacttgcttttaattgtttaaagacaaatcaaaacaatgagttataattttcccctatcacatttaaaatttgatgaagttttatagaacaaggtttctgaggctatagggatgcagtaactctcatgcacagtcaaagtaaaacttggagctatatatttggagggcaatttgacatatttatcaaggttgtaaaaggccataatctttaacccagcaattccagttttaagaatttatccctagggcacatttacataaacaagcaaatatacatttataaaaggatgttcattataacattctttctaatagcaaaccaaaacaaaacaagcacagcagtaccaaaccaaaacaacaatagaaaaaaaagacagtctcctcaataggtaagtgaatcacagtacatccatcctttgaatattatgtagcaaattaaaaaaaagtatatatatatatatatatatatcctctgatatgggaagcgctcctagatacattgaatgaaaaaagcaaggtacagaacagtatgatctgatctatgtgacaacaaagcatatgcagatattcttgcatatgcattaaacaattctggaaaaatacacaagaaactgttaacagagagcttacctctggagattaagactgtggtgggaggctccgatatggacatattctacttttcaattcataatctactgtactgtttgcatattttaaccatgtgcatttattattattaccgttctttatcactaaataaatactattttatatgtaagtgaaatataataccaactccaattataacatatataatatgtatacatatatagatagaaagctagactactatacaggctactctaatagcataggagatggtcacctaagccaaataatgtcactgtcatggttgggggtagggggaggcttactgaaagaaggtgatagccgcactgtattttgattgatgactaagaattaggtgaagaagagagttgtaggggttactccaagaaaatacatattattctatattctatatgttattgtagagaacagtaacataaagaaattattgattgggagctgcagtatggtaggggatgttaggctggagagtgggagcagttgaagttggagatagagacagggactagagactttgaagggctttgcctgccatgctaactacattagactaaagtctcagggactagttttcttgaaaacgatgaactaaaagattcacactgtgatgtaaataaataaaaacaggtatttgcattttaataaagcacagaatgttccacaggtccaatttcaagcattggtaattagggaagaggaatctccctcatgtctctcagttcacacatttatgagaggatgacacacctggttgtctgcataccagactgttctactcagtagggaacttgccacccttctggaggtgggggaggattctattttccagaaaccccctagtccatcactggtaataagaaactagggatagagggtggctcccatggcaaccagtgcccacagccctgtaaacacttatagctgagagggactgggaggcaaacaggtgttctaaccagctgggtctgctggtttctttccattggtaccacatggtccaggggaaagtgcacagattctggagtaagacaaacctgggttttcatactggctttgtcactcattagctctgtgactctgggcaagttacttaatctttcagcattgcaagtctcttgtagggttgtgtgaaataatgtattttaagcacttagcacagtgcctgatgtgtaggaagaaactgatgagtgttagcttttgtaatcatgattattcccacttccgcatgaacccactaaggattgctatagtctttgccatatttattaaattatcattatccattcttacccatgagtcttccaagaacttttgtcctctttctccaaaagtccaccaaatattattattattattccttcttccctatgagcccattgtcgattattgttccgttgtcattattatgaaagtcactgatgatgttatctccccttccctgtgagcctcctgactccaccttatgactcctgactccacctcgtgacttctccaggccccaccactggagggagcagcagagctgaagcgctgttcctgccttccagagccgccctgcttgcttttagcatgtgaagagggccaacaaggcagaaatgaatggatttccaagctctgcctcctctcctacctttcctcctatgctcgccaaggtcccagcgtctcctacagtttggggtttgtgttctctcatcttttcttccttgttggagtgattgaaataaataagttcaaccaataggtggaaacaagtcagcttgagtttcaccagaaagcgtaggaggacctaggtatcaagagaaggtgaaagaattcttcagatgtggatggagtctacgaaccgcagacccagaatttctaagaagatatgaatgtgagataatgaaagttacttctttttcctgagctcttacactgtgctaagcacataacatccttattgcactcataagagtttgacactcattattctcctcctgcagatgaggacgccgaggcgggagaaattaagggacttgtctaaggtcacaggcttgtctgcctcctgggctggggactttaatctctaccttaagctgcagtttaaagagaaagaaaaagaaaacaaacttgaagttgagcaaacatggggcagagacagctcaaggttatttctcttcatatttcaatgataacctcaggttgtgatttttagaatttttctcttgtattttccttttaaatttgttatggctttgtagcctttaacttttgtttgcagttagtatcctttgaacttcattatctgttttctctatgatttctaagagaaaaatctgcagaaaaaaataattacagctaccatttatggattaccttttgcatgctaggcaatttacagacatcatagcgaatcctctaacaactctcaggattaggtctattattattcacttcaactttacaaaaagagaggctgagactcagaaagttttcatggcttgtccaaggacatgcagttggtaagtggctaagtggaagattcaaaccctgggctctttcgctccaaagctcatgttcttccccatactataaaactgactgtttgtgtaccacgctacctcaaaagggtttatggcttgtttttggtcagacaaggaaaaaagaaaagaatctctgtgtgttagccttgggaggaggatgagtgggagctgtttaacagagagcacagaacaatgcccagggcccatggaagacagaggagaatggtgagctgttggcagagtaagaagcatccccaggaatttgtgtcaacaaacccctcaccccgaagttgttgccttcagtagtgtgacccttcaaccactgagtggcatctggaactaagatgtgataccagatgggttattttccctctctctctgacacaactaggctgacagaaggtttagaataaaatgttggaaccattttgcgaggtttgaagggtgtgaggagtagggacaagctcatttctgaagaaggggaaggtaaatgaaatctcatgttttctttgtcttcaggaggtctccaggaggggatgagtcactggaaaatcttttgacagagcctttaatgaaaagtactcaggaacttctaatgctccctaccaggtcttcccttattaagtcccctaatgtgtgaccagtgtgtaaagcaaagggatttgccccaagttgactctctgatgttgtaaaatggtcagtagtgtaataatggtgaccctattaacagacaaagtggcccttttccatgttgtcccaaaggattgtcaggcctggcgccagcaagaattgctactgagggaggaatcttgcctagaacttttttgagacctgccaccatccagtctgctctttgttcccctttgagcctggcctcatttggctgttctccctctggtatgcccctagctagcgtgccagccaagctgttgcccttcacacaccccgcccgcagaccgatatgcttgctccctttgcttggctgccagggagaggatttatatcaagattgctcaactaggaaatgccgagttccatacaattccaatgcttgctttctgtcacatttttgttatttcatagtcttgacctttaacctttatgtcgagaaatccttgtggatgagtctacctttgaatgatttgtcttgcagcctcaggtttaatattctgtgtctcgaattattttagatgcctgggctagtctgcctctgctctcattgacccgctatcaataaacacagggtttgcttaacaataaggcatattctgttttatgtgtgtactcactctgatcaaaatagagatgtttataaatggagttctctatggaggtctaagccaaaccacaacctgggcatttctatagtactttgtaaattgttgtgcaagtggtagtgttagataaaataacacactgaggggaaagtgagtttttattgctataaaactactttaacctaaccttcttcccacacatttcacccttctggcccctcaattatggtagtagggagcagtaggagagcaagagtaaccctaaaatcaccaacattgaaatacagtctcttaagtcaatactcttagtcaacaacattttaacaaaaaagattgtctttacgcataggcctgtagtaggcaggtgggaacctacacttcagcagttgtatgagccagggggtaatttttgaggtctagctttagaagagtgtgctcaaccttggctgtgcatgggaataacctgaggactttaggaatactaattcctgggtcccaacctcagagactttgatttaggtaatctcggggggtggggtgcaatctggtcatagggattttaaagagctcttttggtgattcttgtatgtagccaaggtctagaaccattaatctagagccttgttgcacaaagtatgatatgtgtgccaatagaatgaacattacctaggaacttgtgagaaatgcagatgatcaggccctgccccagacctactgaatcagaatctatgttttaacagaatgccctggtgattcatatgcacattaaagtttgagaggcactgctctagaagtgtcatctcttgaaaagcacactctggaaagaacactagcatagtcaaccaacatgcccgctggcattctgggtttttgaaaatatgacaaataaaccctatgacatcaattgcagagggagtatctacatcagtctaagaaagatgaactctcccactacagaaaaatgagaggaaaaggtagacaacttagcatgtagcactgtttctttctggtctatcttgtaagcttggattcttctgctggtagtcttcaaagactcatggatatggagagaggtgccaaaagactaaataaaacaatgattttccccccaaagcaaggagaatctacaaatggtagcctagtgagtttgacgttgttccccagcaaacttctagaatagattattaagaagatgatttctgagcccttagaaagagacttactaatcactagaaaccagcatgggttcattaagaacaagtcatgccagactaagctcatttccttttggatgggcttacaagaagaagctgcaaaaattatttacctgggcttcagcaaggatcttgacaaacacttctgtgatgtcctttcagacaaggtggagaaatggggactagctgagagcatggatagttgaaggttcaactcgttaaatgatcatatacaaaatgtatggatttaatgaattattgtaaacccagaaagacacttggatcaggttaagatgttgaccaaatttagaactaagaccaagcttggagggacatttgtatacattgtataacagaaaataacaatgttcattgttgtcatcttcaggccttacactggcataatacttttctaattacagagcactttcacatatgttgtttcatttgatcttcaccacaaccctgcaaaattagaatagtgattatgtccattttacagataggaaaaccgaagttgaaagattcagtgatttgccaagtggacaaatacctataaagataccacatgttctcacgcatatgttggtgcttaaaaaaaattgaaatcacggagatagacagtagaataatggttatcagaagctgggagggtagttgggggtgggggggataaagtggaggtagctaatgagtacagaaatacagttagatagaaggagtaagatctagtagttggtagcacaatagggtgactataattaacaataatttactgtatattttaaaataacagggtgaaattggaatgttcctaacacaaagaaacagtaagtgcttaaggtgatggatattccaattacctggatttgatgagtacacatggtatgtctgtatcaaaacatcatatgtaccccataaatatatacaactgttatgtacccataataattaaaaataaaaatgtaaaaagagttttaaaaaatgaacataaaaaacccatatatttgaggcaaatataaagttgtatgtttcagcttcaaaactaactgcatgaactcagagtgaaggcaagtcttagcagtaattctataaagggcatggtagttttagttaacttcaaacttagtatgagcccacagtgttaagtggttgctaaatatgctattgagatctcaggggtatattaatgaaagtacaatgtccatcacattggaggtgatagtttctttgtttccaaagttgatcagaacatctctaaggtactgttttactctgattattgcatttccaaaaaaaaaaaagatgttttatccggaaaaatgaagacttaaggaagaattttgtgttacacattttctgtgggtcaatgggtatacaagctggaataaggcagctcccaggacactaaaaaatttcctgaccattatagttacctgataattgaaggacaaccattctttacagttagtaaagcccctacccctccccctctagaagagttcaagcagaggctggtcagccgcttgtttggtatgttgtagaaagtttgtgcattgtatcatctctgatggctcttccaattctaacattttccaagtctagaattccttcactgtgtctggataaatatggtcaagtccaactttgggtcatcagttgatgaattccccaagactgactgttggggtcaaaatggagcaatggcttgagtaatgattctgcaaattaaggaatcattggctagttttgacaggtttcttgccaagtgccaccttttacaggatttgtctcaagctcagaattaattttggcctctgctagcctgtgatttcacgtagattgttcctggaccttttgcatatggtaccaaagatggccttctaaagtaaccagggatttcaccacaaaagccatcctttgtaggccaataactcatgaatggcttgaatttctccacaaattcttaccacgcccagttgaaagcatgactctagccaggatcctgcagagttaatttaccacacaatatgatagttttggcttagggtccattgtttggggtgggaggggcctgagggaatatctttcttctccagacctgttgccactagtcatgtggtttccttttcagggatttccccagaatggggaccatctcatcacattggccccctcctcagctttggaatcactttatctctctcagggagggaagttgaaagaattttcaacttctacagcagagctgagtggcttggacttctgggagggaaggggagagatcgggtctaaatttgggaatgcatgagtcttccttctcaatgatcctacaggccagcttccatgcataagtggggcctggactagatttccacaggaggactgcaggttttgttggacaatgatgatgagttaggccaaggcacctccttcccttgagagttgcaaggtcaggatctcagagaaacctgagagagcataacttagtggttataaacacaatctttgaagccagactggctgggtccaaatcttgtccctaacacttgctagctgtgtgacctaggcagcctacttaacctctatgtgcctccatttccttttttgtaaggaatgtgaatggtgatagtacctacctcatagatctgttgtgaggattaagatgcataataaatgtaaagcactagaacaaggtctaacaaacataagtgtatgtgagtgtttgttcaataatatacatcaaagagtaggctgagaaggtggtcaatttagtaaaaatatttattgaatatctactatgttccagatactctgctcactgaggtttagcgtgggagagtctggctttggaagcaggcaaacttgaactctaattctagctctgcccttgcctatgagcttggtgacctgggaggatggtacttaatctccctgagcctctgttttttcatgtgtaatatggggataataacagcaaggaatcttacacagtgttgttgttaagagaaaatgagacagtgcctatagatctgacacatagagaggagctcactaggtggtaatacatgacttctgtaagctgggatccatatgattaaacccaacaaaaataaatggcaagtctacattttagttaaaaacccaatttcaaaataacacatcacttgcacaagtaaaggacaagaaaggattgaattggcaagagcttgtgtgaaaaagagctgtggattttagttgaccacaagtttcctgcgagccaacagtgtgatctggctgcccaagggctaatgtaattttagatggcattaatagaaatggtgagttgagattccggccagtgatggttccctgtcctctttactctgtgctggtcagattgctgcagatgtacaggactttatcctacttacaatattcctggatgggcaatgacaagctcattgacaaactgtccagaagtagcgacctgggttggggggaattggcaaactctttcttgaggatgagatgaaaataatctgaggagggaaacactaaggcaatatttgaaacagttctttcttctagtgaaaatgtttacagaacacaccccacatccaatctgtcagcaaattctgttggctctttcctcaaattatatcaatattctgaccatttctcattgcctcttctgctaccatcctgacctaagccagcctgtcttgccaaaattactacaatagtctcccagtagatctctctgctgtcactctggccccctctgtctgctctccaaacagaaggctggagggccctatttaaatatatctccagtggcttcctatttcattcagagcataaatcaaagtcctcataaaaacctacaagggctttctgagcctggttcctattacctctgtgacttcaactcttactctcttccttgcttactatgctccagccacactcctttactcacattcctcaaaccggccaggcattctcctgtctcagggcttttgcatctgctgttccctctgaccagaacccactttgcctagatagttgcatgtcttgctccttcacgtccttcaaattgtaattcaagcattaccttctcaatgaggtcttctcgatcaccctttataaattgtcacaatctcccccacaaaacacatctctgtatctcctttctctgcttcatttttcattaccgcacttatcatcatctaatattccatatactttattactgactatattaattgtttgttttccacactagaagggcagggattgttgtttgtctttgtcactactgtaaccaatgcccacaacagtgtttggcatacagacagcagccaataaatatttgtagaataaacagatatataaaatatatcaaagaggtgctctgtttaaatctgataggggtagggtaggcatgaactttgccatctctggaacctgaataattgagagttaactacatgaacacatttgcacatgaatgctggccaaactctagaagcaccactgagtgagcactacaggacatgggggagacaactcccatcttccaaactttggaggattattatgtataagaagtagatttcatcggggttgcaacttgaatcagaactagagccagtgagtatgaagggagtacacacaggtagatacggaatcaatagaatgatttgagattctcaggttgtctgatgaagtggtaagctctctagctttggaagtgtacaagaagaagctgtatatctctctgttagtcttgctataaaaaattttctgaagtggccggaggattgattggttcataccaccttgacaatctttgtagctctgagatgctacagccaaaagtcaaaagtgtgtgagcccaaggatgaggggtaatatatgtttgttttttacaacttgagagaggtctttggcctttcttcctggaatcccagagacaaattttccttgcaaaagttcattccatcctaattgcgattccatttcccagaaattacctgatgctgggctgatgattagtggccagccaggggtaaagggactgattcccatggcaaccaggttgaaaaaacataccatgtggagaattgtcagcaacgagctacgtttgcattataaatagatatttaattcattgagatagtttgtgacaacttctgcattataaataggtacttaattcatatagatagctctgacagcaagtaggaaagttaaaccccaaagccactctttgtctttaagtatttcagagttaattgacaaccatttttttccttctaaaacatgtagaacttggctaagtgggagaacggtatatgtgagtgtttttagaaagccaactaatagtccaacgtcacaacatttctcactatttgtttctcactgaaagatttttcagaattttccctgagtgcaagagtatctctctttgaatccttttgacacaggagaccccaggttcaatgtctggatttcacaagagttatttcctgtcatgtttgtctcactgtcaccctgcttttctaactcagaggcatctcaaaatttcagtacttggccctctgctcttatcttcccatttctctttcccttggtgaaagctaaagcaatcacgttatcacttgctaacttacacaactttactagccttgacaatatacactttggaacacccaaaggttggaaaacagaatcagatctgatcaaaggacgtttatcctaagactgaggaccaactctttccggtgttcaaaatatactgcttgattgagggttagggatggagagtttgagggcaaaaagtggtgttcagcagcaagcagcaattaagtttggctaaactcaaatgtaaaagtaattttgaaatgcaatttttacaaatactatagtaaattagtataagggactaatagaatctcatcaaatggaaatcagagtgggactttgtacttctacattccaaagagcttaatacaaattagtctataatactcagagtgtttcattctgtaaggattaaggtaaatgggatgctttttttttttcattaacttgctgtgtaaatatgcttcctaatgcaaccatatagaggagttgctttctaaactttattataaccagggttaaataactcaccaggtactgtacccttgtacattgctctattgaacagtgttagcttagaattaaacactgctgggaggcaagtttaacttctttagggtcagatttgaaggggtcatgaccccctctcagacctgtaggtcactttttctgaggtctttaacaagctttgaggaactaggtaagccacccaccccattccaaacggcctaatggcctaatgtgtactgaattcccactcatggggcaagtggccttctaatccagggggaaagatcagtggctgagaatgggagctagccccccgccccaccatttccccatttggaatcctgggaggcgacactggcaggtcccctgttccaaaccatccacctcatctgcttactggcttcttgagatcccaccattacacgcacattcctttgggaaaatggaactctctttagagagggacaaagtatcagatttgattaattgttcttacttaagagtgaattcatttacaccctgtgattgctaggtaagggtcacaaagcgcgcttttccagtttcaaagtgctgctgagggccaatcccactgtttgaaagtggatgtactatggacccaaacgtaacacaatgaaatgcatgtaatgtctgtgttttccctcctcaggctcaacttggagagagtgttgccattcattcattcatctatcccatggaagggcaaaagaatactctggtcagtgactatgtgtcaaaccaaattgggaagtagctattttggagccccctccccacgcccatccttgaacaactttctcttttctcgtacccctgcactctcttattctgccatcgagatcagctccaatacatcatttctaaattgttagtggaaaacagaccaatagaagaccacagccatagtttttgaagttaaatagtgaatactctttttattcagaagaatgcatttttaatagaatttcatgcgccagtaaatcagtacagtgaggagttacaggggtggggaacctctcttcaggaaacatctcaccctggcagagctctcaactcccagaatcccctttacccagctcaggtgattagagaccaaggaacagcagatggggctgacttgcagggtaactggttggatttataggtctctgagagcaagagagaggagaggaaagctcttgtaaaggaggagattattatattggaacgggcagttccacagagattctctgagaggttgatgaaggagaattggcaggggtgcctggttctccttcttggttacactcttcaagggcaatggtctggtctcttccgtctgtctctgagcctctatgtaaagaaaaagacatgagtaagggaggacccagaaactgaaaacagattgcacggtggggctcagatactaggggagcatttgtatgattgtttttctagcaccacctggttcacagaagggggccataatgaggcatttatttacctggttcgcagtcgaggccacttcttccactctatggctagcactacccccaaggctacaacaaccaccacgattaggctacttcggacaatgttccctacagtgcactcctgagcaacaggccctgtggtgatgaaagaggagaaaccgaggccatggagattagcgtgtgtatgttccccttgatctggtattgccccacactctggccttctttagggttcacgtgggagccatctgttcagactacagagggggtgggcagtggcagagtttatgctgaagcagaagcagccctcctttccttggggaaaagaggcctgaaaagaaacccactcactatcttcaaatatatttaaggtcccacctcctcatcatccttaggagaaagatgacacacttcaggtccctggctccaaagctcctccattctcctgatttgggatgtctccatggggactgtccctgggatcccaggtgtgtcacaccaggaccatggagagattattctcttacctgctgcccccaccagctccaggggatcactaggctctgaccagatatcagggtaggcctggaggcggtagctgcagctgtagtttccaatgccttttccttctacgttgttgatgacaaagtctccatcctctgaaaactgctgaggtgcttcttctccatcatgttctaggacaaattcaacacctggcaggggtcctcggcactgaagggtgatgtccttccctaacttgaacatggtgctgggccaggctgacagagagggtttagggggcttatctgcaaccaacaaggacacagagttaaaagaaatgatcctgaacttagccttttacccccttattgcttactgctaaaaactacaaaatcgtgacttgtactgaagtctccaggaccttaccagtcacccagatctccagggagtcactgtgatttgaagctgcaaagggagtagagtccaaataataaacacagctatagatcccagagtcttcacctctcactgctggcatccagaagtcagccctgtacccacttggcctctgttgctctaaaggctcctgagccccctccttcaacaggacaaatgttgagtctggcagttccccttgacactgaagagtcatattttcgccaggggccaccatgggaccaggctgggctaataggctgggtttggggagtaagcctggaagaaatgaactcctggtcaaagagaagaggtcactttccagtgcatcacccctggggtctctgctcaataaagaggaaaggcaattggttgcctctcctcgagctctctgaaaactatctcccatgaactagtctattccctcctttctacacttccatgcccactcgacagcctcttccccttacctgtgactaggagttccagggtgttgctaggttgtatcttgatagaactggtccagtcagggtggtagcagcagctgtaacgccccatgctagtaccagatatattggtgatggggaatgccccgtcattactggtggatccccagagctgcattgaagtggcttctccttctttgtgcagaatgtatcctactccatggaccggccctcggcaccagagagtaacattctgccccatgggaaccacagaactgggctcagcaaacaaccatggcttagggaatgtgtctagaaagagaccaaggttgtaaagtggtgactatagaaacttatgagttcctgcttaaattaacactctatctttctcctcttgggcacggtagttcccctccgtggcctagcctagccttccaggaggaattactctccctaaccccttctccaatgatctccatcccagtcccatgtccggtcggtccttaccagtcacccagatcataaggggcatactgagatatgaccccctgtttgacatggttgtctcatagtagatacagctatagttcccagagtcctctgctccaacagtgtggagaaggaagtcagctgagttccctgagacactccgaaactgtaagggaacatgggctccctcctgcaagagggcgaacctcatgccctggaaagtcccttggcagcgcaggatcacactcttcccaggaaacaccacaggacctggctgtgccaggagagtgggtttggggtagaattctgaaattaaagagaccacagcatgagataaacccagccctcacatcctgcaaatagccttttaaagtgttattgtaagacacaatatatgtttgttgttaaaaattagaaaatatagaaaaaaaaactaatgaaggaaacacaattctaccactcaaagataaatatttttaatatttaattgccatttattctttccatatattcccatgtccatgtagctataactgtttacataattgggactccacttatgcacagttgtgtagttgtgtagtatgcagctgacatttcaaggtcttctccctttctctgagagccatccagcccaccggtctctgacagcccagctagagaaaaagtggacattgagcctaaagctcaatgccaagccataaaaatgtgcagaaatagggcaagttgaaccgagctcttgggattagacacccccatctacctcatttatttccccagaagtgaattgcttgcctccccactgcctttgtttcttgttcctgtaataataacatgagcagctgtgcatcatggactggtcactatgggccagccgctgtcctaagcacgttctcagtgtgttttagaagaaacatttcttcctctcccactgacagccttccacccaccatcccagggttggcaccacctctacctggagtcccccctcctaacctgtcaccacgagctccacagggtcgctgggctcagaccagatagaaaagtcataatatcggcagctgtaattccctccatcaccaatgcccaccgaaatgattagaaagtgagctgcactggcccccggacttgcccaggacctgtcactggatgctatttcacttccatctttgtaaagaataaagctcatatgctggtggggggtggagcaattgaaagtcactcgggcaccaggggtgaccacagggctggcccatgtcttgaagaagggcttagggtacatttctagaaggcaaaaaacaaaaacaaaaacaaaaaacaaaatacaacacaaaaccaaattaagaacaagaaagagagaaagcaaatatagcaaatattggttctcggaggcttctttgcttttaagtaagtgcatttaaaaagtaaggtaaatccactttgcagatggacttctcacacagggacccttcaaccccacccctcactacctccagatgagtcctcagtgtgatcagggcaggcaatggaggctagtaaaaaggtagaatttttcttggggttctgctgattctctgagcctcagtttgcccatttggacaaggggaaaatggtacctgcttcacccaccttgaagagttgctctatggtgaagtgagataattgatgtgaaaataattagaaaaattaaatcaccctccacgaaccaaagctattaataacgattatggctattaatatcgtgcagccagaggccctggcactcccagcgccacgcctgcctggctctaagattggacacaggctctcaggaccagcagcaaagtttgctgcagggagaggagtgtctgacccagggctttgcctttccctccaccctgccccctttcctcccacacccttttcagctctaccttttatgacaagctccagcggctcactgggctcagaccacttgaaggggcgtttttcagtgtgagtgcggcagctgtaattgccttcgtctttatcctccattctctggattgtaaagaaggcttctcttccaacagcaccaagttgctggacaggttcttgctctccctccttatacagagcaaaccccatgcctgccagccatcctttgcaccggagttgtagttcctggccccggattgtgggggaagcagaaatgacaggtttggggaggatgtctggaaaacagaatggggtgaaaaaggagtcagaagtttgcagttgcccagatgggatactcagggtcactttgtcagcaaataaagacattcattctgggctggccctaggctcttccagtcagtctcctcacactctctttcccattccgcccctccccctaccccataaccccctaccatttcagtgcccctcctctcctacatgcagcacgagccccttgggctccagggtccctgtgagttcattccctcactcccaggagcagtgttggagtcccaggggcactggggataactcccggagaccctctacattttcttacctgtccccaccagctcaagtgcctcactgggctccgatacagccatctcctcccatgaatggcagtggtagctcccggtgtggctctgggtcagggcgccaagggggaaggcagcccggacctgctctgaggccgggcgagtggcgatccacccggtcccatccttcagcaacacaaactccttagttgagccagaagggcttctgcaccagagggttaagttcttccacggggccagaggaaagttggtctctgcccacagctcaggcttaggggttggcatgactatttctagaaacagcagaattaatgaagccatcctcccgcctcccttcccctccctcctccttgcccttgaaccctctacccagatcacactgcccacctccccttgcaacccaaatccaaaccctttccttctttccttccttcctcaggtgctggggaaaggggaagctggtgtcttatagctgagcctcagaaaagtgcagaagcttggaggaaattttgcaggcagaaaggcaaagttggaggctgaattttgccagcagctttagcaagtgccccttcctggctgcccttccctcccaaccagccactccctggccaatgacactgacgctctgtagttatttcggatctccagggaggaatgtcccagtctggagcaggaaaaactcaccagtctcttctatcaataccccattgcacagtcctgcaaaagaaattgctgccaggactcggccccctcccccaccgggacttcaccccggccttctgcccggggccccttcccccacttgtactcaccacagcagagaagggccgtgactatgaagagcatggtgaccccttgagctgttcccagcaaccaggcttctctagtgagaccagaaaagagatgagaggagttgctgggatgagggggagggtggaggaaagggggcggcaatttatgtcattggcttactcgctacccaatggggactggatatggccaagataatgggatataatcttatttgacatcaatgacttttctttttgagggccttaccacctacaaacctcttgctctttcatgacccacgtgtcccccccgccccctccccactccgcagcctatatcatatgtcagctccccatggcccctgattaggttgttgctggaattgagatgtcagatgggaaaatgcttttatattatttggagctctcagaacccctggagctcattgtgatcggcagctctgggtggtgtgtgtgggggtggagggagaaactgtgagtatttctcagtcatcaagtttaagttcggaagcagttgttgtggcagtattggtcctcagacccacctgcctcacctgcctttgttatggaagggttgcctaggcagctgtgatgaattactagaagattggcagtgccgagccaagcttttcagagagtagaaactctcccctcacccagattataactagaaatgtgcagcagctttgggtcatgagtcttgtagtattagatgatattaacccaaaatccatcggacaatttttacttagaaaacactgaccatccttcctggtgaggaaaacatgattttcaagctgctttctctgaaatctggttcctgatcttattctttgatgcagtgttgctgggctggggtggggcacataaagctacatttttttttttttctaaccactggcttggagattactctaatgagtacgggacccaggtcaggttccggaaagaagtagaacttgacccctgctgaaactttttgaaaactcaaagggtggtggtttttgcagaaggcttaggtggctcccttctgattgcccaagtattctgtccctcagattccagtggaaaacacagacacatgtaatcataatcataatccattgtgcattgaatacttccagacacactgaccacagttgcagggcggggggtacagccagaagcagggagtagggggaagtagacaaggtattcaggagctaacatccctactgggtcagaagtggtcatttctctccttgttcccagtagagtagcctgagcacaagccatggggatgagagaggcagatggcccagagcacaccacagaatcaaaggaaatggcaggagaatctgtttggcctgtgagtttgtgagtcagaggaaacagtctgattctgttgccccgtccaatatcacatcagatggccatccaggtcaagtctatattcccagaatgctctgcacaggtggttggaggccacagtgtcagagactggttactaaggcaactaggatgcgtcacaaggcttaatagctcctgagagctagggataagggtgaaaagttgggataggagttggataacagtctgggagacaggacagcatggcttcttacaagaggaaaaatccagaacaagttaatgagggagacatcaatcatctctgagggcaggatggtttgtgggcgagatttgggcaccctccgggggggatgtcagtgaatgcagttctgattactcctcttgcctctgagaactatgcatttctccacccgctggcttgagtgctgacccctctgtgaggcgaaagagacaggtggggtgagaaagtcttgttccctaagcccagaagataggggttctatagggtttgcctctgtggcttgtctcaactagggcatgactcattcttcagactctgttaggttggggaacagggggctgggacaagacagttacctgattctgagtctccgacacttccaccttatccacagcactaccaacagcaaggcaacaagctgcatgattagagacaacctgatagcttcattcagaacgtaattccaggtgagatagcctgtggccagagaagaccagaatcagaggccttgatggggacaggggcaggtgaatacattcatggggtgaggacaatctggttactgacagtgcttatattgagaaggtgaggcagaagtggccttctttttcatggagaatgggagccttgaaattatcctgctaactgcctttgaggaattgtgagaccaccccaggggaagggtgctgaaacccaagggctctgattttcaggcctctgactccctttcccatatctttctgggcactgatctgggatccctggggtatggaggggcattcctctgaagagttatcctctcacctgctggccccatcagcttcaggggctcactgcgatgtgaccagatgttaggatgtgtctctacgcgatagctgcaactgtaggtccctgtgcctttcccgtcaacattactgatgatgaagtctccgtttactgagaatttttggaatgtttctctttcttcccattccagagaaaattccagtactggatgagatactcggcactgaagggtgatggcctttcctagcttgaacacagtgcttggccaagctgacagggagggtttggggggcttatctgaaaccaatccagagaccagagtgagaagtgacctcaaacccagtaccctctcccccagaaaatgtttctgagctccccatttgatcttctcttcctttccacttccacttggccagtggcttcaagatttgactgtgcattagaattcctttgcccaccccttggtgatctaaagattcctggttccttaccttcaatcaggaagacctcatacctgtaagcttcctctggcctaaagaaaaataattttcccaggggttacaatggggctgtgccatactgagaggtggagcttgaggaacaatcctgggagacaaggtccctaaagttttggaagaaagttctacaccaccttcctagtgcgtgtgtgtgtgtatgtgtgtgtgtgttttgctcatagctctcagaggatatgaggctactagctccttcttacaacaccacaatgatgataaaaacaaacaggttgataataaaaacagttgttaacacttgcctacaaccataagctccacagtgttgtgtgatggcatcctaatggaggtcttccaggtgagaagatagtggcagctatagatgccagtatcactgtaggttacattgttgaggaagaatgatgtgttgtcatcgatgctggtggcatccaaaaattgaagtggtttgtcttctcctttcttatagagtgcaagacccactccatccactggtcctcgacaccgtaggctcacattctgacccatttggaccacagcactgggccgagcaagtagccaggtcttggggaaagtgtctaggatgagacccagaataaaaagcactagtgatttcacttcctgctcccactccttaagattcttttccttctcttcctccaaaccacccttggaaaaacctgcctacacccagttttacaaattctgctcccttctctactgttaaccctggccacaggattaggttctccagggagcacagagggagatttatatccttagccgttaacctaagtttcatggcatacccgtctcttaccagtcacccagattttcaggacatcactaaggagtgaacctctatatgatgcgtcatagtaaaaacagaggtaatgtccagtatcttggatcttcaaagactggaagaagaaatttgcctcattttttattgtcttcttgtggtaaaaggacttctccaagtcttcaaccctcattagagcaaaggtcattccatagattggcccttggcacctgagattcaggctttctccaggtgccatgatgggcccaggatgggctgtcaaagttggtttggggtagagtcctacaaacggaagagaccctaaagttagaggcaagatgattctttcctgttgtcttctgttttctctttcttaatttctttgaacaagaagtggtagctgaagtttaccttctcttccctatcccttccttggatctctgcctctgtaacataatcaagggtagattcacttatgcccctgttctctctcaagaatctgccagcttcactgagctctaaccatgtgtaggggtgtatctcagtggaagatctacatctataattccctgtatctttaggcccctgaaatgccaaatgtagttctttcaaccaccagaaaaaccaaacctctgaaaataacattgttttcatctttgcagagcatgaatgccactgaaatattaaggagagcttttgaatacattaagctcatttaagaccctacttctacaacaagactgaaagaagccaataaagagggtttggccagtaagtctgcgacccaaataaatctttgttatggggccacacattcctttccatgaattgtttctccaaggagattttacatgaaagtgagggcaaacctcacctcctaccactccttcctacccccaccccaatgccaggcacacttatctattcattaaggaaggatcagctctgtcatatgctcactgagcatttagtatgcatcaagcgtcatgtaggtctaggtgtgtatgagtaaagaagacacagtctccgctagcaaaaagctcatgaactggttggtgggggatattggtgaacaggtaactacggaagtgtattttagtggaatctatgctgaaagggcatgagtacaacaaacattcatacactcagttcaaacaggcagtttttgttctttgatcctcaataaaaagctatactaacaaaattaatatctaccatttattgagaacttatatgccaggcactgtacatatatatttaggcaaatcctcacaacaaccctgtgaggtaggcattattattaaaccaattttgcagatcaggaagctgaggcacagagagaagcattacacagtagatcagatagatactgttatcccatttttagagtagaggaagccaaagcacagaaaagtgaagtgacttgctcaagaccacacagggaggcagtgtcagaaatagaactagaaaccagtattactgcttctaagtctagggtactttctgtagcaccacagctttccccaagcctatttagctggatagagagactaaagcaaatgtggccaattccatctagaaacctccaggccatggggtgggggagttcgggctgggacatgtctggcattttacattttggggaaatttcttctatatttagagattggtgctgccttactagctctactgatagggaaccaaggtgatttataaagccatttctaaaatatgagctatcacattctttgtcatttgtttttttttgtttttactcaccaacactagcaatccattctgttttccacacataaaaataacaattacaaataaaatacatttgcaaatttaaaactccatttataagattgcagtggcagtgcctggcacatattaggtgctcaataaatactggttgaattaatgaatgaatgcatgatattcaacaagttgagaacaacaaagctgtgatgagctgaagctgctggccagttggctgggctcctttactagccaaatgattggctcccatacatctgccttgcagcacatgccattctaatttatatctcagtaaaacttcaaacgactgtagctcatggggccttgcagggcctagaaactggctgaggaaagtaaaatcagaaaccctagctcagccagccatgatacctgggacaacaattgccagatgccagcagccatagccacacccacctgctacaaccagcttcagggggttgctgggctctgaccacagggtggggagcatctggatatgagtgcggcagatgtaaaccccttcatcctcaggtgtcaggttgtcaatggagaatatggccattgtcccagttgggacttggtaatccacaggctctgcatatccctctttaaacagcatgaataccaaatcctgcagccagccatggcagaggatgttaacattacacccaggaagagcgggggtctcagcctgaatccagaagatgggcttgggcagttggcctggaaggatagaatgaactggaattaggtaaagcaaggatagtactgtctagggagcagcagaggagagctctactttaattgaggtttccctgtatgatccttgtttgccacccctccttctcctatctctgctccagagtctgcatcccccctctgcattgcccaatacaaagtaggcccttatttactaactgtgggatgcatgcttgcatgcatttgtgaaacaaactctcccctggaaggcaagtttgaatctcaggagctggagttgattcttgagtatcactgtcatcttacctggtgcctccaactctagaactttactgggctttgaccagcctgtctccttccagtagcagcaccggtaaagacctgcattggactcagtaagggcacctataaggaatgaaacttggaaggtcttgtgggaagggcggatccaggtcatctgtgtcttatccttcagcagcaggaacttgcttgatatccgagaggggcttcggcaccaaagcgtgatgttctcccaaggggcctgggggtagttggactctatccacaactctggttgagggtccatcactgttattcccaaagatcaaaaagatatgagcagtccaaccctctccctcccataacatgtcccacaatgtcccttaaaattagcccggacccagatccctcattttgtcttcccttggggacaggagtgtgctcctgtggggcatcgtataagaaccccaagatattttgtcaaggggtccaaatgaattggagaataaagtctgatggtctcttttccatctgagataaagctttttcaccatgccataggaaaccaagtcctctgattcccaatcagcccaatctatctctggaatctcaaggcattatgtccaaggtcatggagacacgccagcatcttggatcctttaggaaggaggtgcctgagagggcaggactcacttacctattgatgtcatacccagactcatccctgaaaagagagattatggtaaaggagagctcccttgttgtctccatcctgtgctcaaacctcaatactttcctctcccacccctaatgagtgggtacctatgacagggtcacttgcccctcaccccttccttgtactcacgaatgcaaaagagcaaaacagtgaatgtcttcagcatggtggccccctcccctggtctgtccagggtcatggggcctctggtgctggctgtgtgctctgagtcttgaagaatttttctcctcagcaggtggtgggatctaaaagcagaattgtttttactcagaggacttgtcctgctccttaaagtttagtttagatggctaaattgcacttgacaaccctacattgtacttcctcacaggcatgcagggtattacaaggtcacctgctgcttcctctccttgctcctttccctcacttccctatcctgctcaaggtctttgttggtatcaaagatgtcagatttgttgaaatatggatttgtctctgggatctcagaagcccagaatagcctgcagaagctccacaggatgggggagatgggaggtgcagagtcaccttttcagatatgcatatatatatatatacgtatgtttatatacgtatatatatgtgtatatacatgtatatatatgtgtgtatatatacgtatatatgtgtgtatatatatacgtatatatgtgtgtgtgtgtgtatatatatatatagagagagagagagagtcctccaacaacttaagagagggggcattactaccatccccattttactgatgaacaaactgaggcttagagaggttatataatttgcccaaagtcaaaagatattaaatattagagcccaaattagaatccatgtttaactccaaggcctatggatctaaaacaatgatttaaactcccagaggtacccttcactccctcttcaccctcccttacccctctcacttgatcccttggatatccttcccttccatagaatgctttagatccaatattactctcattcttgtctcctacccctaaaagctcaataccccagtgtcaagcatgtgttagaaaatcaagctgcttgagttaatttacataaggtctaaatgattctttcgttgcccttaacttctaaacagttttgttgattgcctctaagggaaatggaattgtttgaatctcaggaaatacggcaaagatatttgagttcagggaggctttccattctccctgaccaaagtcattatttaccataggccttgcatatacacaaggtagactcttgagctttcatgcctctctccacctccccccacagtaacctttcaccaagggaaggtatgtcccagccacgcaaactcaagctaattctcttccaccaactttctactgggagtctgaagtcctggctgactccagctgttattaaatcttagctcagaagagtggggaagaggcagctcccagaatagagaaaggaactgattttgcttttccagactgaccttggacctcagcctcaaacttgccccagtgctaacactgggtaggatggaggagcaggaagaggaggatatttcgtgttcaaaatatctggactgtagggaacaagtggacagtgagaaatccaaggaagcataggtccattgtacatttttcactttgtatcaaaggattttcagattacccactctgaattttccttatctgtaaagtggaggagtaatatcgacctaacattattgttgtgttgggttagagataatacatgtacagtgccaggcacatagtgaacattacattttaaaaagatgcttattttttcttcttttcaaagggggcatccaactggtgtagggccctaaagatgccctttccatctcagttcctacagtcccttgctcccactcctctcagggccaggccaaagcttggatgctaccctgttgctttgttaccctggggctttgggccaggagtttttgggggaagccaggttccactgccaagggagaggttcaacctgggattacacccaggaaatgccatctgaggtttcagccttgccacttggacccctaaaccaggatctttgcctactgggggattgaggggagtcagggaagctgggctttttggcatggctgacccctcctcaatcactaaggaaattgtaccatttatattcagcccagatgatgaatcttataccgggggaacatgagaacagccccaagccttgggttagttggccacgcccattttggcctttcaccccacccccacccccaactttggctgcctagccgttttacccttccctcctactccaccccaagcactttccccacccttaggcagcgccgcagtgcttttgagggtgacatatctgaaatgtctaatggctcgccccctgcatagctttgagggctccaggaatcaaaggggttgggctcggcggggtgccgggtacatgctcagctgagggtttggagggaagactgagaaggaaaaggggagatatctacagtgcccagagattctcaccgaggcaggtctgggatccgggaaggaaaggagaaaggcaggaatgaagcgggtggggggacagactggggagcagtttgatttacggcaattaattacagcaaggagactctttcggggttttgtttaggatccggtggccagtatttaatattcagccactgaactatgcgctcatttgtaggtacttacggtagttgaaggcccgctccgatgttggagattctccagtgagctcctccagatgcagcaaactgcccggcatgagaagagctgtctaaggacagcctcttcggctctgagccccgccttcctctctcccccgcccgcctgccggcccgccccaacctcctcccctccctgcgccgggctcggggagcccacctacaccaactctgcctggcacctgcagtcctctgacgacggggatttctacgcccctcccagctccccgcctctctccggactccctgcagaggttgctggagccaaattcaggcccctgccccctcgcctgtctctcagagtttcactgggtcactgtattgtgggggggagaaggccagctctcaagaagatttgtagatccttctctccagctccccaatacctttatcgggatctcagatcttcccctgcccattttaacgccccatttatgcataaacatcaccacagtttaagtgcctactgtgtgcccctgggccctgggatccattatttctcatcttcagagcaactctgcaaaataagtgttactcccctcagttttacagatgaggaaacggaaactcagagagggttaagtaacttggacagccttcaaagtccatcttggggtaaaagcccaggctttagagacatacaaatgtatattttagtccacattttacattcaatagttgtgtgacctcaagcaagtgagtaaactctctgagtcccaggttccccaacagtaaagtaaaaaacaaacaaacaaacaaaaaacagcagaacctatttcacaaggcctcaatgggatgatgtaagtaaaactaacagcacaataggcctagcatgtagtaggtgctcaataaatggtagtggttgctgctgctaccactactactactactattaatctgtaagcccttccccaaatgtcttagagtaacatgattttaataatatagagcaacctttcacaaatgttgattatgaaagactttttataatgataatgtatgaataagacactaatcaaagctcctgatatataacatatgatgagattaaagtatagcatccaatgggctcacagactaattgataagaaatatcaacatgatagactaattggctaaaaaatagacaaatttttctttatgtacatttccttttttttaagacagtctcactctgtcgcccaggctggcgtgcagtggtgcgatcttggctcactgcaacctccacctcccaggttcaagcaattctcctgcttcagcctcccgagtagctaggattataggcgcgcaccaccacacccagctagtttttgtattttttagtagagacggggtcccaccatgttggccaagctggtctggaggctcagcctcctaaactgctgggattacaggcgtgagctaccatgcccagccttttatgtacattttctacctgcataaaagatttcaaattatctaatgaaaaacactttaattcaagaacaaactgtgtaaaaataaagtaacagctcttttacagccaaattgattatcatatcttcatgcatcaggtgatatcaattgtggcttccattataaactatagattattgtgtaatgaatagaataggcatatgaataaaaagatgtgtttctgggcaagttatttagcctccaagcctcagttttcttatttgtaaaatggggataataattgcacttactacaatgaagggtttggggtaggattgaatggaaaccttcctgtaagccaccacatagcacctaggacacagcaagcagccattgattcaacacaaatgttaagtactttctttgtgtcagggattgttctagatgctgacagttcagaaaggatgacagtttctcttcttaaggagtttgtagtctaaggataaatcatactagagaagaagtaggaggcagccagagaaggaggagccttgagaatcaaagaggattgcaatagaaaagatcatcaagtaagtcatgatagtatgtgtttggataattgcaagcactttgcttgtactgtgtgcctaaactagggagcagtagcagagaaggaggggagggtcagagttcccaaaacattgagaaggcaacattagacaaacttgatggttgtttggaagacaacagtaatagttattatctgtcagggtgaaaacatccatgccaattttcaaaacatttacagtatagaagagcttcaagaaagtggagcttgaaggatagaggtgaagcaccaaggttcacagggtgttgtgggaagcctttctccataagcgagtctaatgtaagatgatgatattttttaaacctaactctgttttatatatcccaaacaggagaagcccagggcaaacctgatcccttcccagtgttgtactgatgttggctagctctgtatggttcaggagaacccaatgtgcacatcttatctcatcccagcattcaatgacataatggtagtagcttgaaagtggccatggtcagagaattttcaccacagtcagggaattttcacaactgaagaagtaaatgctacaaatcaagtttctcccagcaaccttcacatctctggagctgtttttaaacatttactagcaaaccactttttttccagttttatgttttaggacagtgatttttactgggaaacaggaaggtttccaaactgctcaaggatcctgttaagtttcatacactctcaagaaagttatgagcactgtgctccattcccctgtccccaacctcactactctagtaagccatctgaggactgtgtcagatctctggagaggtctgtgcattcaaagtttgactgtgtgttttagcatcccaccccactcctcagccagtcccaggccccatccctttctgcaatggagaagcaatgtggagtataccagtgaggaactcagctgggactaagcaagtggcgttctggggcagggaggaggtccaaccagacagattaggttccaacggcaagacctgatgaggagggggttaggctttggaggtggggaggtcaaagctgcaaaggaaagctggggccaactcacagagcttgaatttcaacttatcttttgtcaagcactttaattattaagggcagagtttggggcactaagtcatttccagaagctataactgagggcattttcaggagtgtgcaggaagcttcctagaataaaccaaattcaagtgatgaattagaactaaaacttatttaatcaaaacactcatagtggggcattagacattagatagaggcctggatgatcaggcttctgggtgcttgtcacaaagcaaaccaacaatgtgaatacctaggtgattttaacaagtttaatgggtggagggagaaaatgaggatttttgtgtgtgtgtttcagtgttagcagaatcacaaagttctttttggtttatgtaccatttaccaaaaaaggtaatctactagtccactgtctccaaatgacaattctcttagcatcacaatatggcttttgtttatacgaggaacagtgtgtatctgagtacatggtgggggagggtgttcagagacagatatccaaaatgcaggagagctccgaaagtgggcttcaaagtgtttcagtattcccttttcctgtgttggatgaagttggtggctccagaatgaaaggaggtaggctcagcctcactgcctagagcaggcaggcacaggttctataagcagtttaggcctgatccaggaaggatgcttccagataccagtgccaggaaagcctttttctgtctcagagtctgacttgcccccagtgtgtccaaattgtaggcatttgcatggtggggcaggggtgggaatgggtgtgttgtggtggggggatggggggggaggggggaatgccgcttgggaaggcacaactggtctctctaatatttatttactcgtaatcacttgtccaaaggaaactatagaagtcaataatttggttcttttattcctacgtattgtatgattaaacaattatatgattaaaattaagtaaagatggctaaactgcaagagcaacacaaattagcaatttaaaaactcatcattgcaatattaccaactgtttataatctgttcctaaaaacatcagtttacaggcaattatttaaatatacatgcatctcttccaattctacttgttttgtgatctaggatatggtcagactttctgaaagattcatgtacccttgacagaagatgaggaaatactttctccataaaagtctgttaagttcatataattgattgctttcaggtagacaatacaaattattttttttcttaatctatcatatttcaatgtctccctatccaactcatgcttaattattatcttgctgttttcattttctccctcccgtttatccctccttcattctttcccattttcctttttgaactttccttatcatcctttcccatgcattctgtgtgtgtgtgtgtgtgtgtgtgtgtgtgtgtgtgtgtgtatagctatagatatacacacataataacaacttggtacaaccgtaaatttttacttccttttccgctaatcaccctggcaaaaacgcaattaattataaaaataagatctacactctcttaagaaatgtggctttgaaagtgaatttagtcacttatctccgcgagtatcttctccctgggctgcagctgttttcagcaaaaccaatagtttgggagttttactgacaaatgccttgaagtcatcttgactgccaaagattttcctctcatcttgaaataagaaagatagcttagctgaatggttcacatggggcttcaagcccaggaacttcaactagtagattttgcttcaaattggtctctcatccactgttactaaggtatactcaggtgtcagtcctatatttatcttgttgaaaatcacttcttttttgagcagcttctgagacaatttctttatctttcaagtttaagaattgtacaataatatgctttggacttttagtatgagagatacatttgagtgggaacttataaattttctctgtatataagtcgagatctatgtttagctctgggaaatttttatcaacagtttccttaataatggtttcaaggctaatctctttattttctgcaccttcaaggatgcaagatacataaatattgtaccaccttgatgtgtttttgagatctatcatgttttcttgcaccatgaagaactgttttcttagatgttttatcttttaagactgaagctcaattttgtcctcatttgtactgattctctcttccatgatatttattcagcaatatttctttcttagggtttctttccattctttggcctcactagtagtgccccacagtctttgctgagctttttctgtgtgctttttaaaatgtccacatggtcttgcatcaacgccctcacctcggccctttgtctgggttctgcctgctgctcctccaggacagccatatctcctgaattctctgggcttcctggttcctcctcagcatcacagtacttattggttgctactaaacttgtttttatcatttttctcattctagatcaggtaggtttcattttctttttgtgctactctcatagctgaggtttccattggctttgtcagtgttcccaaagcccagcaatttggttcggagcacagctgctccttctatcctctccccgagaagctcaggagctgaggtctttttattgaaatgcaagacctattttaagctgaaatcctcagaaatgctataggaaattaagatatcatcaactgatgttctcatctaacaggattagaagtaagagcttcataaccttacagataaggtaaagaagtacataagtgcataaataaaaataaacacacacatataaatatgtaagtgcactaactacctgaatacataaatatacaaacacacaaaagtaatataaatgaacacacaagtgcatagacatagaaataaatatgaacgtaaaatgagtctcatatgttcataatatttagcttctgcctagctgagagttcacagaatatgtttgtgattaagcaacgaagtatatcagaattataaagcagggaatgagaggagtttacctacatgtttcagtgtttgtggaaagggattttgacttagtgtcgggggtcgaatttcagtcctggcagagccacttactagctgggtaatagtgtgacatttggcaagctactgaaagttatttgagtctccatctcctcatcagtcaaatgagtattcaataactgtgagctaaatctgaatatagaactttctgtttgcctcatcctaatcattactttttaaatatatctttttacagtgaatatctgggattttgattggtgggagtggaaataggacttgatagggagggggaacctgaaaaggtcccaaatggataccatctcagttcccagattctttttgaacaattaaagagtaaatattccatttgactatacccaaagtattatagaaagatggaaaaatacactctatcttcaaggttatgaattcgtgggagatatattcatattcacagctaaggacgatataatgcagaacacagtatggagcgtgaaacaaagcattgtcataacatagagaggagagcatttaattccaatttgcagtgcttagaagttcttcgttcaagtcccccagactcaagcatctctatcattgagcatggtgaggtcacctttatggcctcctgctccaaaccatctgcttcacccacctgatgtcttcctggcatcccaccatatgattcacatctttgggaatacagagcaaggaatcacaaagtattgtagtgcatggtgtgtggagatagtggcagaaaatgaggttggagacctggacaggagccagagcattacaaaccatgtgtgccctaatagcactttttagtacaatttcatatttgtgccaaatgaaaggccaggtcatgatctaggtccaaacagagggcttttaaccaagcagaaaatgaccttctttagctcctaatgctctccctgatgttagttatgctatcctgggcacagatcctcagggacaggactcagaggccactttctgagctgacagtccacctgttcctctaattcagtctcctagtagttcaggtttctgtttcaaaagaaaacaaaaactggagatgggacagtttacaattagagtcacatgtattagacacccatgtttgaaagtgttgacccttttcaaagctctaataatttttaaatcaggctctgtcttagacttcaatgtatccaagcagataacgtttaatggggtttgtaggagaacattttagaagaggagatagtgtgtagggaaaagaaaattgaaattaggtctggtaaattcaaatgcaaaaggtgatttaatctgattctcatctgtgttctcagaaatactcagaattcgtatggaaaattagtataagcacctaataggattaacctaataaaaattagaacaggtgcttggtatttctacattcaaaacaaccgaaaaatagtctttagtgcttggagtgcttaggaactgtgagatcttaggaaaatgggatttatgtattcctgcatttattcaaaaatattaattgcacacctactttgttttctagttctggagatatatcaacaaagaaaacagaaaaaaaaaccatatatccatctataaatatttgtcgtaggtatctgagtaaatacattttctagtgtttgaatataaggggctatttttataactctactgttactaaagatacagaactgacttttgctccaaactataacaacaaaattcttggatgtcatttagcaatgtctgggattggtttgggtgtagatgactctaaagagatttttgaatggccctatccaattttctttcccttaagccatttgttcagaatcaaatgagaaagtaaggcaggaatggtagaagtgtagaagaaagcccttagcatgtttaaaagggggtagaggaaaaggccatttggcattaaatatccttttgattagctatgtgacctttacctacagaaaatttcttcttagtgtttttagcaagatcttcagaaacttaggatggcataatccagttgaggaattgcagtgccaaggaaatctactctacaattgttgttaggcaccatgatgttaaaaatacatattaactaatggaaatagtgctggacactaattaaagtatccaaatgacttttcattattaataaccctggatttcaacaaggagcacttgctgtggaagttctgtgactatcctgggcacagtatgacaatattttaaaaatatgtacaccatgaaagaatcccacttgaaatagctgtaagatggcaccaaaaaattaccaagtggaacttagcatagacttaaaatgaggtggaaatttattcttatgacttctatctaaactaaaaagcagtttaaattttatatgctttgcaaaatatatggcagacttaataccatatgctttcttgaatttcaaatggttaactccaatactcacttatttagccaacctttattaaatgcccattataaacaaggaacacttaaatatttggtggaataagatgggcaaagaatggatggaagaatggatgaaagaatgcaaaacgctctaggcatacattagcagctaaaagattaacaaaatattttcactgcccttctagtaactaaaagactagaagaggagcaaagacatgtaagcagataaaaataaaaatgtgctaaagtttgataagaaaagtggagagaaagtggtcatggaagtttagcaaagagcaatattctcatctgaggggatcagcgaaagccttgtgggtaatgtcacatatgaactgaagtatgattggattcatctggcagctgtaaatactacatggttacttctctgacagtagagacttattcatctgtgtatctcctgtgcctaatacagaaataatgctaataatagttagtacttatgaagtgctcactatttgcaaggcatcacgttgagcatcttacaaacattgtcacattttctttcacaacactctggagcagtgcttataacaatagcagtagcagcagcaggggcagcagcagccacaagagcaaacaatatttgttgaatgctaactatgagccaggcaccagtttaagaacttcctatagctattagcatccatttcttacagatgagataactgaggctcaaagaggttaagcaacttgcccaagataatacaagctagtcagaggtagaccgggggcagtggctcacgactgtaatcccagcagtttgggaggccgaagcgggagaattacttcagtccaggagttcaagaccagcttgggcaacatagcgaaaccccgtctctacaaaaaatacaaaaatgagccgggcgtggtggcgtgtgtctatagtcccagctactcatgaggctgaggtgggaggatggcttgaacctgggaggtcaagactgcagtgagccatgttcacaccactgcacgccagcgtgagagacagagcaagaccctgtctcaaaaaaaaaagaaaacattagtcagaggtggagctgtaatttgagcccaggtcatctgattctaaaacccatgttattgtggctcaatacctgttgcttagaataagtaaatgaaaatgaaaagaggaagaaaaagagatattgtgaagatagaaaccattgaatctgcaaactgttgggggagaaagagtaagaccaagagcaagactgaaagagagagagagcgagaaactgtcactgtattttcagtctaagctaagaaatgtaaagatttttctcctgtaaaagacaagctctcatatactggatttttaaaattattttataaagtatttgagaaatgttaagatttttaaaaatatctagagtaatatcccgtaaaggttacctagaaaaaacttcaaagaagacacacaaaatgtacatgttggttattttctatgtagtgaagaattattggaggtgctcttttttcttcatccctgtattttatattgctacaacaaataatttatgattaaaaaaacaaaatttgagaagttgggtaacaatttagggcagaatttttaaataatcaaaattatttgttgttaagaaatacacaataggccagcacagcggctcatgcctgtagtctcagcactttgggaggctgaggtgggcagatctctcaggcccaggagttcaagaccagcctggccaacatggcgaaatactgtctgtactaaaaatacaaaaattagcctggtgtgatggcatgcacctgtagtcccagctactcggaaggctgagaggcaggaggatcacttgaacccaggaggttgaagctgcagtgagtggagatggcaccagtgcattccagcctgggtgacagagagaggctctgtctcaaaaacagaaaaacaaaacaaaaacaaacaacaaacaacaaaaagacacatttaaatatttagaaatttatgttaaaatgagaaaaaatacactggtttgaataggtaaagcaaagcagcagaaagaaaatgtatatctatacagtgtgtgtaagtgaatagtttatagttcatatgatgagttacatttcatatatacatatcataattttagaaataattttttaaaatcaccagaataataaagtctttactcttcctgtagcacttatttctgttgattttccttcttttagcaccaatgctgcctaactgtctttcctaaagttgccatttgcacccaaagaaacccattcctagtttacataactgatcatattactgataatatcatttgaagagttcacttctgcccaacttcttaaatatcatcttgaaatgatcacatcttaatgtaattacactatttttactgagctaactagctgtttagttgaattgacttggatatttggttaaatggaaagtcggtaggggacttttgaagagtcaggtaaagagaattggacaaatgggaggctaattgcccaaaaaaggcccaaattgtgggcctcatatgaaaatatggattgccatgggaaccaaggaaaaagaagaggaagaagatagttattagcgtttttgaaattgcttttagttctgctgtccaattttcattaggtcagatctgatggctgttattatttttattataattctttgtctatgtatagcaccattgtttcttttcccccaaagtgctcatagatccattttgctcattttccttcacaacaatgctattatgtagagcctgggtacatggggccaatgcttattttcttagctagcttagtgtacagcacctaattgcagaaaaacaatctgttcagaggtaatagtgcttttggactgaatgttgatacgtcatatataatatagccattataattgataatggacataacagccttatgatacttttgaaagatgctatgaatagtattcttagcagctataaaggactaggcatacattgaggagaactggaaatatactaattatgtatctggattgagaaagttttctttaaatttgtgttccctcagagtttagggagagtaataaaagcaaacaacaatctaaattttctcttaaaatgagaagaccattctgtgattttataaatctgtcaccttataacttgaggtcatctgctagaaatcattcatgtggaaaacatcaacagagaggtttttctaagactcatgtttatcacaaggtaataaggttagattgaattttttaatgtaattttaatttcagctctaaataatttgtatctttttcaacattaaaaacacaaaaagtacacataaacaccaagtaagatctaaaaatttcctgaagtacattagccaccccatttatataacgaatatcttctttgtttgtgaccgtctcagcattaagctagataagtagatgcaaaaacgaagagagtttgatttgtgacgctgtccattgcccagcaacgagggattatggttgtttttgcagcattgcaccattttaggaggctggggacagtctaggcatatgccactttttttccaccttgcctgaaacaaacagcaaaatgaaaaaatttaatgtattatttatcaacaggttaaatttgagaacatttacattttaaagatgaattatgaaaatctaaatgtccttgaatgcttaattatctgtgccttctttctgaaaaaattaattatcaaaatgaaaacagaacaaaatggtacatttacatgactataaaactgatgagagttattctcaaaaatctctgaaataagcttaataatgcatcaaaaataatgtttaaatgttcacaaatatggaacataaatgtaaaatcctgcatttggatcccaaaatcaccagatgcacaagcagaggatgagatgtgactaagtagcaacatgcgtaaaaaagatttaggggcttttagggactgtaagctcaatattattcagttgtgtgttgtggctgcatagaaaaccaaatccatcttcatctgcattagtagaaagatagagtcggaaacaagggagtgatagtgcatcccagctctgtgcttggcagacctgtacttgaagtattcaatgaaaatagcaggatggggggaacatatgggtagcagccagaagctacaaggcatctagaagggagaaagcaggttgcctaagagtctggaaatcattctggtgaggggctgctgagagacttgggcttatttaccctggaaacctctccactccctaaccttttcttttctctctcttgcccctatttcccatcttctccatttctttctcctatccttcctccctaaatagttccctctctaaagctatttaccaaatttggctttttgagactggtattatttccatgcataccctaaacaccacacttcctgcagcccttttttctttctccctggttcttctgcctcctcaatcacagccatcaggactgaaccacagtaagtcccttccccctcctcaacccttctttttagaaagggcttcatatccctgggaaaggaaatagaatatgaattaactaacacagacccttaagctgaggccttgtaaaaaaatggcccaggttcaaaagaagcaattctaataaagcaataaaatgaacttctttagtcccgctaatacttgttggcattagacatgggaatttgagcacagctcctcatgggtgggccgaaagtgcacctgtaacactaatctaggatgcttaaatatcaggttcccatttaccaagaaaaaaggaggggggagtttgttaatacaaaagcttgaacatagaacattaccgcctgaatgattaaacctatttcagagggctgaaatcctaatgacaccaatttgtcaaaacataagagttttaatggggagcaggaagggtaggcagtggtatgcaacgtaggaatcaacaactgcgtactttaaaacaaaacataaaagctctatctggctgaaattctcagaatcactatgggaaattaggtgtaattgactgatgtgatatcatgtaatagaaataggactgagtgctcagtatcctcacagttaaaacaagtaaataaaatgagttggcagtgcataaaatgcttatggtgtgtaacagttcatgtaaattgtctacatccttgatttaaacatttttgtaaacataaatttctatgctagaaagttacagatggaagagaagatgaaacaataaaatagaaagggcacgtaaaaagggaagggaaggacagatggaaaagagagggaggggagaaggggacaaaagaaaaagaagaggggaaaggaggtacaaaaatagagtaaaaataaatttaaatgggaaaataagaaaacaggagagagggagataagacgcaaatatttgagtgactacgtctccattttcataaaatcatcaaagaagtgagaaactacagggttgtttttcgaattttgatcacaacaaatccttgtaatagtgctgataaattagactgggtgaaaagggagagaagtgtgagtcctgatgagttcttggtccagtcatctcttccaggacccgttcatctctttccaggtacacttgctctgagtagaggggctaggcaagtacaccagcactgctactcgaatgctcacagcaactttattacaatagccttaaactggaaacatctcaaatgcccatcaactgaggaaagaataaattgtattacattcaaactacagaatactacttagcaagagagaaagaggagagagagagagagagagagagaacaaactactgatacatacaaggacttcaatgaatctgaaagaaatactatgttaagtgaagggagccagatccaaaagcttatatattgtataattccatttatgtggcattttaaaaacgggaaactataggtaggagaacacactggtgattgccactggtcagggttagaagtacacaatttctgcaaagggaaatgaggcaacttttggaggaaaaggaaatcttctttttcttgattctggtggtggttatatgtctatgtgtgtttgtcacaactcagaactgtatgcttacaattggtgaattctaaattatacatcaataatgccaataaaaacaaataaacaagcaaaaacaaatgtcctaggtcaatatgctactagtggtgttgcccttacttctttcccctctccaggatgtgtgtagaaagaagatatctaggggcccaaaatagagattggagatttaaggatgcttgttcacagaattcttcattgtcttattaatcaagttgagatttcttactctaacattcaaggtcctccataatgtaccccactctgcctctccaaccttgactgccaacattcttacatgcatcttcttgactattatcaggcagttctgctcatttcatacaacatgcccttcctgcctactttcctataatacacatactatgtttatttcaatcaatttgccttggttgatgctggtttccctccatgttctggcatgtcttacccttatttattcaacaatttattgaatgcctactatgtgctaagtaaagtgctagtaactgaatatacattaaaaagtctgtctaaacaaattcgctaaagtctctgccttcacagaactcacaggcaattaagcaggtcattacactgtagtttggaaagggccatacgatagcggaaaatacaggatattaatagtctggacaaaaggaagccatgcagacttggaaagataatcaggacttgattctcgaaggaaataacatctaagaagagacttgaaagatactttgggatgctctgggcacagtcgggagagtactccatgtagaaagagctacaaggcagaaaggtctgaaggtaagtgagagtatgggaagaaatttcagcatttaaaataatttaagtacatcatgaacatagaagataaaacaaacaagacaatgatagtggatagagatgcttgagccaggttacaaatggcttttaacatcatatcaaggagtgtgaaatggaagagtggtatcctcatgttggagttgagaaagattattcaatctacagtgtggagaatgaatagaataaggagaggcagggagacaagttagtagatgaggcatttttctaagcaacattgactacagtggtggcaggtgtaatagaaaatatatatttaagagatgggagtaaaattggcattatctatccatagatttgatagtttcagtagaagaaataaggtggtatcaaggatgactctcaagtttctgtttggaaacttgatgcatagtggtaccattcgctaagttggggacacaagaaagagaagcagatgataaatacaaattcactcttggacgtatcagctcatgttttttacccttgaccactcttgttcacatcaacctcccctatgggaaatcctagagcctgggccgttcccttgagcctttgtgtttgtacagactcctgaaggagaatggaaatccttggggacagggtttctgtctgagacttctatcacctcacaggccctatccagtgctaagcatagaatgagttgtcaaaaacacttactaatcaattgagccctgtcacggggcaataaaatgtgatgtgcaggtgggcttgtgtcatacccactactgaaaatggttagcgataaagaagagtttcagtacaaaaaccaaagaaacatagcagggaaggtttaagaagtgcctcagtttacccaattagaaaacaatttcatattaaatccaacagagttacttaatatttaaataagaactgttgatagattattttgtaaaagagacaatcctctggtgatcttaagaatcataccctttgagaatcttcaagttggaagaattctgcaaggtttactagtccaacccccagttgttaccacaattccttctataatatccttgcctgtggtcatctagctggtacttatataccattaatgaaagagaactcattatgttcaaactcaacccattccatcttcagatagctctgactgagtgttcttgtttataattaacctaattatgtctccaaaatgaaagtttcatttatgtattattcatatgtttcaatgcagagcttataaaccttttagttttccgttctttaggtcagctcttaccagtttcttcagctattccttatatggtatggttttgcattccttaccccccctggtcacacatccgggtatgtggcagtttattcataactttcatgtattctggccccagaaatgagcaaagtactgtattccaggtgtcatcttgaaaggacagagagcagcagggttattgcctccctcattttggaaatttttctcctgtaaatataatctaaacagatagcagcttttttatctatggctaattgtggatacctattgaatgagtgttaacttcaaactgtcttttacatacactgctgctaagctatgatctgtgggaatcaagtaaaaatctcaaagtgcagtttaagttccctctcttcccatttattttatcaaattttaaagtgaaaattaatagattacatctctcctcactgaggttcatttgcctttttctgttgggtacatgaagattttatgtaacaatgattcttatatttatcttggagcttgctatggagtgaaaatttttgtctcactaaaattcataggttgaaacccccaatgtgactgtattttgagatagggccattatgggaggtaattaaggttaaatgaggtcataagggtggggtcctgatccagtaagatttgcattcttatacgaagagacacactctctcaccctgcaacataatagtgaaaaggcagctgtctgcaagccaggaagagagcccttgccagaaactgaccatgccagcaccttgatcttagacttctagcctccagaattgtgagaaaacaaattcctgttgtttaagccatctagtctgtggtatttagttatggcagcctgagcaaatgaatacagagcaccagcttagcacagggcttgacatgttaccagagtttaatggaagtctggctatttaattgaaagatggacattgtctacaaacagtaaaaagtgaaaattactttactcatacttatcgtgctttgacttttggcatctgcagtaatatgggaccctattattggtcatatgaaagccagtttgggatcctgaaatcacacccaaaagatcactgactaccttgcttcacctttgaaggacaatttcactggatataaaattatatattggtagaaatttctttaaacagtatgaagatttcacttcactctcttctcacttgtatggattctgacaagtctactataagccttacattttcttcatctatagataaggtgttttgcctccctgcactttgtcttcactcaagattttctctttgcatttgatttttgcagtctgaatcaaaatgcccaggggtgtgtgtgtgtgtgtgttcggtacttatctttcttggtgttctctgaacttactggatttgtagtttggtatctgtcactaatttgtgatgttcttggtcatttaatgcttcaaaaatgtcttatgctatcttttctctttcttctctttctgggattctaactagattttttacctcctttgatattatcttatagttattgtatattttgttctttttctcccctcctcctgtcagagccactgaaaggattttcctaattctcattatgagaatattgtgcaattcctggaggaaaagcccacaaaagtgtggagagcccctctatgattttccccctcataaacttctcactctcacactagttcacatttaatctccagtaatttttcataattactagagaattaattaaatagtcatactgtttatggtttccagcaggtcttcattagataagcagatatgaatgcgcctatctctccagcttttgagatgttgggttgttctgccatctcaattctctgaggctaagaaaagtcatcagttttctatttactgtccagcattttttcattgtaaggatgcgaatggcaactttcaagctccttacatgttaggggtgaaagtggaagtcccctttatttttttaattaagagaaaaaagttttttgtatttgctaagatctctacccttttcaataatcttcatttattccaaaatatctgagtttctaactggtattatttctactctgcccgaagaaattccctcagtagttattgtagcgtaggtctgctggtgactaatgttattacggtactgatggatggaaatattttctattttgccttcattcttgagaactatttttgctcaatgtggaattcttggatgagtgtttgcttctgtgttttagttctttaagatgtcattcattccactgtcttctggtctccatagcttctgattagaagtccatggacatttgaattgttgtccatctgtatgtaaattgtcatttttctctggcgactttcaaaatatttcttcataaaaagcacccaaatttgaaaggaagaagtaaaactatctctagccacagaaaatgtaatctcatatacagaaaatataaaaaggaaatattaaaaatctactaaaagctattagagctaatgaacaaattaagattaacacatgcaagttcaacacataaaatttgatgtatttctatatcctttcatcgaacactatgaaaaataaattaaggaaactttctatttatgatacaacaaaaagaataaaatactttgaagtaaatttaactgggtaatttataaaggatgtaataaactgggtaatttataaagtcttgtgctaagaagtacaagatttatacagtgagaactacaaaacattgttaaaaaattaaagaaaacttttaaatacatggaaagacatcctgtgttcatggattggaaaacaatatttaaagatgaccgctatggtttttgtgtgtcccccagaattcatgtgttggaaatttggtccccagtgtgatgttgttggaaggttgagcctttaaggggtgattagtttgtaaagagggagtaaggttgctctcatgggagtggtttaattctcacagggatcagtgagttcctgctctcacagaattggattagttacagcaagagcagattgttataaagtgaggctgtctcttgtgttttgtttcttttgcaggcacccacttcccctttcagttctctgtcatgttatgatgcagtaggatgccctcaccaaaaaccaaccagatatggtcacttgatgtcagacttcctacccttcagaaccatgagccaaaataaaattcttttaaaaaaataataacccccctcaggtattctgtcatagtaacaaaaaatggactaaaacaatgaaaatactattcaaagtgatcaacagacacaacacaatccctaccacaatcccaatgacttttttttcttacagaaaatgaaaaatgcatcctaaaattgatgtaaaatctcaaggaatactgaacagcctaaagacttttaaaatacaagaaaaaaagttagctcacactttttggttttaaaaccctcttcaaagctatagtaatcaaaataacataattctaaggacagatacatagattaatggaatagaattgaggctccaaaactatatgcatacacttatggccaattgattttcagcaggtgtgccaagactattgaatgagggaaagagtagtttcatcaacaaatgatgctgggtgttctctctcataggtgggaagtgaacaatgagaacacatggacacaggaaggggaacatcacactctggggactgttgtggggtggtgggagtggggagggatagcattaggagatatacctaatgctaaatgacgagttaatgggtgcagcacaccaacatggcacatgtatacatatgtaacaaacctgcacattgtgcacatgtaccctaaaacttaaagtataataataaaaaaaaatgatgctgggacaactggatatccatatgcaatagaatgttttatagatattgtctaatcgatggtaaaatttatatggaaatgaaaggacctagaaaattcaaagcgatttcaagaaaagaacaaagtcaggggacttacataacccagtatcgaaacttactactaagccatagtaatcaagagagtgtgttgttggcacaaggacaggcatttagaccaacggaagcaaattaaattttcagaaacaaattctcacatatacctcttcaacaaagatcccaagacaatttgacaaggaaaagggtagatttttcaataacagatattgtgacaattatataccccaatacaaacaaaatgaaaaaaaaaaccttacatacttacctcacatcatacaaaaaaattaactcaagggcatgctagtcctaaatttaagagctaaaactacaacatttttagaatgaagcataagagaaaatctttctattttggggtaaggctatgatttctttgatacaacgccaaagacatggaaaaaataatttgtgaatttgcattttattaaaatcggcatttgaacaccaaaaaccattattaagaaaatgaaaaaacaaaccagaactggaggaaaatatttgcaaattgtacatccactaaatctttttatccagaatttatgaaaactataatatctcagtaataagaatacaaacgacacaattgaccacttaaagatttaaatagaaaactcactgaagaaaataaccaaagggctagtaagcacataaaaagatactaaatatcattaatcatcatggaaatgcaaattaaagccatgataaaataccagtatacaccctctggaatgtctaccatcaaaaaaacccagactataccaattgttggcatagatgtggaagacagtgtggaagtttctgtaaagtttactgtaaagttatcatgtgaccgaacaattccactcacaaaaatctacccaagcgaaataaaaacatatgttcagacaaagacatatacagcaatgttcataacattgttcataatagctccaaactggcaacatggcaagtgcctatcaagtgatgaatggacaaaagcaatgtagtttatccacacatgaaaatgctttttggcaacttaaaaacaagccactgatatgtactataatagggataaacctcaataacattatgctaaatgaaagaagcaagacacaaaagctgcagatgtattattccattcaactagaatatttaataaaaaggtaaaatttttacaaacagaaggctggtcagtggctgtctagagctttgggtaagcgctaagattaacattaaacaaacacaagaaaacgtcttagagagatgaaaatactttaaaactgaacagtagagatggcaggataactctaaatctaataaaataattgaattgttacacttaaacaatgggtgaattttatagtttgtaaattaaatctcaataaaactgtaaaaagaaagctaaaaagaggatattatgaataaatttatgccaacaaattcagcagattccctcaaaatagaacttaccaaaaactaactgaagatgaaaagatatgagaaaaacgagttcgagaccagcctggccaacatggtgaaaccctgtctctactaaagatacaaaaattagccaggcgtggtggtgggcgcctgtaatcccagctactggggaggctgaggcaggagaatcgcttgaatccaggaggcggaggttgcagtgagccgagactgtgccattgcactccagcctgggccaacgacagcaagactccatcaaaaaaaaaaaaaaaaaaaaaaaaaaaaaaagtcatccaagatgactggagaacccagaatggaataaagactatggcaaacgtatataactctattagaaatatgatataccttaattggagaaggtggagagggaagaagctgacaataactttgggaaactggtttgtcttgtactattttaaagataaaaacaaaagtaacgacctaaacactgtaatctagttaataaacatatttcttttattggcatgatttagcaattctgaaactacactatacatgtactagggttgaaaaaataagcaagtatattataaatggtaagagccaagttcctctatcagagaaagaagtaacaaataagcagttcaagtgtattagctttttattgctgctacaacaaattacataaacttagtggcttcaaataatgcattttgttttatagttctatagggctagaattccaacatggttctcaatgggctaaaattaaagtgtcagcacaatgcattccattctggcggctttaagggataatctgtttccatgcctttccccgattttagagaccgctcatattcattggcttatggcaccctttctttctcttcaaagccagcaatgttttatctctctgtgtctttcttgcatagtagctgactccctgtttggccctcgtcatctactattaaggacgcccttgtgatacattgggtccatccagacaacccagaataatctccatattttatggtcagctgattagaaacaattccacctgcaatcttaatttctttttgccaggtaaggtaacacattcacaggtttcagggattaggatgtgaacatcttttgaggaccattattctgcctactactggaggaataatagaataaaccctgtattattggattaaagtcagagatagcagtgtaaactcaagtttgttttaatatatacacaagtagatacaaaataaagtatagataagtgtatatatatacatagatttcctagctcttagcacatagaagtagtaacacctcagtagtaacaagcaaacttagttccagatcttggtttctaaacactatcctctaataaaagcagttagggtttcttggagaaatggatgattttagggctgatacaaaagagacatggattaacttacagtggctgaaagtgctcaaaaatgacaaccacaaccaaaaggataagatgatgtcaaaaggttatagtacccaagctgaaagaatcctcaatggtcaaacctgaacaaattggaacgacaaattaaatgatgatagtattgtattttaaatcaaaggataaatgagtccatactgatatacataaataattgaataaatgaatgggggaataaaaaatgattctcacttatagaagaattccagttaataatggtaggagaaatgagagaaatagaaaatcataattagaatagcaacataataatctgcaggcaagctctgttaataaatgctaaaattagtaggtgaaattttaaggagacataggatatttccatctccctcccaaatattatgtatttctgtggttttaaaagatatgttaataaactcttttgtacttcttctaggaagtggagttaaattcttctctgtataactgtaggctagacttagtgacttgcttctaatggaaagactatgaactgttactgagtatgtattatgtatgtactgagcatatatatatacatatatatgtatgtacgtatgtatgtatgtattactgtgaagactagtttcaagtaaaaacacctataaaacaccaccttgaccaagtggccaaggttaacatcacgagtaaaaaatcttatttcctgatattatatactgagaagggcacttccacctctgtgatattcttcttcttaacatatgaccctggtctaatctggagaaaacataaaagttaaattaagggagattccataaaattattgaccaatactcttcaaaagagtcaaatttgtgaaagaaaaggaagactgaggacagtcacagattggcggagactaaggagcaatgataaaaacaatgtggcatcctggatttgacactgggacaaaaaaaaaatccattagtggaaaaactggtagaatcctaataaagtctgtagtttagtaaagagtcatgtgccaaggttaatttttggtaaatgtaagcatcatggttatgtaacatgttaacagtaggggaaactgggcgaaattagactgaaactctctgtagtattcttacaattcttctgtaagtctaaacttatctctaatctttttaagggggaaaaatgtgaacagacattttcacaaaggcaaatacatgaacggccagtacacacaaaaaagtattcaatatcatttttatcagagaaaagcaaattaaaaccacaacaagatatcaatacacacccacctgagcactgaaaataaagaaaactgtcaacactaagtgtgggcaaggatgtggagtgatcaaaattttcctacactgtgggagtataaaatggcacaacaactttgaaaaacgttctggcatttcttataataccaaattatgaccaactaattacatgcctttatatttagtaaataaaaaaatgtcaaaataaaaagttgcacagaaacattcacagaggatttcatcataatggcaaaaactgggaagcagcctaaatgtctattaatatgagaatagataaacaaattttggtatattcataaaataattgaatactatgcacaatattaaggaacaaactaagactacttggaatattatggatgaatctcaaaaacattattttctgtgaaagaaacctcatatataaacatacttactgtcttattatgaggtttcagaacagataagactgatgtactgtgggaaaaaaatcagaacatgtttgcctctgggggtatggggcaagaattgactgggttggggaaggagaggactctgggatgatagtagcaatctatattttgaaaggtatttaggacatacatatatgcatttgtctaaactctgcaaatgtggatttaatgcttttgcattttattgtagataaattttacatcaaaagaaaatctataagcaacgatttaactctagttaattatacgaattctctagttaattatacgaattctctagttaattatacaaattctcaaagatttagtgaggagtatattgatgtttgcaattcactttgaaatgcaccaaaaaacaaaatggattcatggatggagagaaggatggttggactgataaataattgataaaataactgcagtaaaacgttaatggtagaattgaggttgtatacttatagttgtttattttaagttattttcaacttttttgtgaaagttattaagatctttgtttaaaaactggaaataacatacttataaattaaccattttaattgaaccaatccatggagtatgaaagaatgattttttaaaaagcagagtatgttttggaaaaatttgcatcaaaacagattaaaattaaaatgtggcacttaaaagctgatcaagatggaatcaagaaaacagataagccatgatgtatttgctagctgggtgccaaagccttggtggtggagtgactggtggggagagggcttaaaggtggtagaaacttaaatagtagctgtaggccttatggctattagacaatattcagttgttacagaactactgctgtgtacagtccagttgacctatcttgaggaagaaatgccttcttgggctaaaaactgaatgggtaggatcaatgagagtgctgaactagaaacagatattcaagaggcaggagtaggactggagtagcaaacaagacagaaaaggctgtagttggttgctatcaccatcagcatctctacatcgtgtctcagagtcctaagaaggccatcagaagcattggggtatattttggttgtcacaatgcttgggaggtgctattgacattaagtggatggagaacagtgatgctagctgtcctgaatgtctgggataatcgcatataatgaagagctgttctcctacacagctttcaaatattccagtgagctttaataatgtatgtgagaaaacggtttatagttatcgaattttgtcttaacagtagcttttatcctactgtttcctgtatctctctctgccttgtatgttttcccatcttttatgtgatgcctcccaatccttttacttttcttaaatatgaacttattcagtataagttggtgcaatcatgtatttcattatgttgtctgatggagtcgtgcccttgcatttatatattgaaatacatatcattttattgtaaattactttcctttcattcctcatttatatttcagttaggtcactgtattgatttttttgaaattatgtatgtaggtaagttatactatctatgtacttcatttaaggatagtgaagagggagtcacaaaatatttgttattaagagggagtattaggtctcacaggaatgagaactactgatctagagttaagaatgaaagataaacatggataataagtgaggctttaggttgttgaaatcctgactcatcattaccatagtaggaggaacaaatattcagtatgagtgagccactggagcagaaagtttctgcctgagaaaaatcattaccagtgtgtgtcaggcccttttcatcagcatgtcattttatcttcacaacaatcctgtaatatatgttctattattatccccatttttcggatgataattggacctcagaaagatgaaatcagtcctaagttctcttagtcgctgagtggcagaacctggagtggaactcaagtctatctgataccaaagccccatgctttctattatcctactcagcctctacaaaagcaagctagggaagaaagtgccagatgttcccttccctctacagaagcagcagcctgtgaggatccatgagtactaatctttcagcatgtatggagtgcttcaagctgtgctaggaaatcagaaaaaaaaataacatagaagtcccttgcccgcaatgaatttcttgtctaactggatatgtaagatgtataagtatagtgttaacttagaggataaagagaaaatggtgatagctgaagaaacagcaaggaaagtgtgtgtgtgtgtgtgtgtgtgtgtgtgtgtgtgtgtgtgtcccattgtgtctcatgtatgtctaaaggaaacctccacaaatatttactgagtgtctaccacgtgcatggcaaaaagcagagaaagaaattgaacgcatggtgaaatgctgggacatcaaaccagtctttgggatggtgggaggggaagagcccagggcacagaggaaaggacatatctgcttgtcagaggccagcgcccacaggagaaggggcctacaacatgaaagaaatttgagatgccagctagggaggcattggccagacctgctgtgcaaaagccaggatgaggttattcttttcctttgagtaagagttgagagcggaggaggcaagttgagaggccaaggagaccagaaaaggtttgggacaggctgtgggcatgaatacaaccaaagaatcaacaataaatgaataaaagattgtggagctgcctgcagggctccggggaagttaagctgctgggatttatgcattggttgattatccactttgtgcgccacccatagtaaatattcaaccccaggcagccgcctctgcaccttccccactcttggcctgctagccaatgttctgtctcatttatttctaacttatgagcaatctaagcaacaaattataaagacagagcatacacacatagggtttgctgttataattaaaatttacaacaaaattaatctgacacatatttaatgatatgcataattgttattgtactgggtggcaattaggcataaattgtaaacagttcacataaatgcctgtaattagaattacttccacacagttaaaccaaattcttagtttctttcctgagtttgtcagcccttgtatatccctcatctgcatctacgtcagcagtgcagatactgagttggtgtgaatcatcgccttcttcaagcacttgttaccattagagaataaaatctggggtctttttgctcaacagtttcctctggctgctacccacagggccctctcaccttaagtgcccatgaagagccagctctctctcgtggtatcctctgccaactcagggggtgctgcctgtcctctccagagggatttcagatggggacaatgaggaaaaccctggctagtgatggtaacataggggagaaaattagctctgaattttagggggcaggtggatcacagggcaagaaaatgactgagttcagcatataacccccttccccctgttcctgatcctatgaaatgactaatactgtcatctttatgaatgtctttaaggggatacattctcacttaaaagaaaacgccatttcatcctaaccgtcaaaacatcgctccctccattccaatgaggctatttcctgaaatgcctttaaactccagataggtgttgcttttactttgccattaaaaataaattttaaaatcccaagggagccagcatatcaataggaatacatacctaaactttagagtcagatagatctagatgccacaacttgctagcagtacaattttggtatttaccctttctaaacctcaatttcctcatctgtaaaatggtgataataatagtgtctatcccatacagccattgtgaagatttcataggatcacgtatataaaacattagcacacagcctggagcatagtaaaatttcagtaactgttggatgcatttattactattgtggcaattgttgcttttacctgtagccttagcttcctcattattttgatggtcccttcatttgttttcttctgtaggaagcagaactgcaggaaatgtatgaaatgctagtggtgaaatctggatggtgaagccaccaatgaccttaaatcaaacagaacagcacagatggctcagactctcatctatattcgtatttgttagaggaaggttggtgctgacctggaacatggcaagacctggcattaagagaaaacggaagccaggccagatgacagatgaaaatgatcattagaaacattcatttcatcaccaaaaatgtattagcagaacctcagtgccttaccgatataagtgatttaggcaagatattttagaagggaagagagcacatgtgagttaacatgtgcaacagcatgacaagggcactaatggaggggtatcctcaatacagtggtaacacccaggatggaggaagtactcccttctgcttgggtggttcagggaagcttctctttagagaagcaagttttgaagtgagtgtacaaatacactaaattgtataattttttttaagccagtgtttgtcaagaggcattttctcatacagctgaattttctgaacttaccttgtgcctcctcaaatgacatggatttcatggccactatcccacttaccattcctccataacaagccccaaaattagtggaataaaacaattgaattatgctcatggattctatggctcaggaatttggtcaggtcatagtgagaatggcttatctctctttcacaatgtcggggaccacaacttggaaaattttgtgactggaggggacttgacagccaggaagtgggatcatctagaggcatctgtgctcacatatcgggcagctgatgcgggttgttgctgttgccctctgttactgtcctggtcatgctctattggtcaaagcacagcaatccttctatattaaaaaggagggcacatagattccacttctcaatgggaagaatatcaaagaatttgaagatatgatatagaccctgtgggccttagatggatatcacttctgtctccttagagactgtcaactggaacacctctacacaatttgtccatgtgacttggtcttaacagcatggtgacttcagggtaattggacttcttacgtggtaccttggtgctccaaaagcaagtttacagcagacaaggcaatagcttcctcatttggtatgacccagccttggaagtcactcccaccattctgagtcctaccattatgcctaggagacccttcgttggtactcttgtcatgctctattggttcaggcagtcactagagcatctctctttgatattcaaaaggaaagaatattgatcccacctattgatgggaggaatattttaaaatttgtggatatgttttaaactctccttagccacccatttatcagaccacaaccattgaatatccacccattgactaaccagaaggtaagaatgccaaaggcatttgttcattcatttattcattaagtatgcattgagtacttacgtgggacaggcacagatgttctgggagacggacatgtagaacataaatatacaaataattacataatcactactttgctaggtgctaagaagaataatgaaatattgaaatagagcctaactaggtgggggtgatggtgttggcagggaagtaaatttagaagaggtggccaggaaatctctatcgggtgtcaaatttaaggagagagcagaagtataaggagccaactacatcaagttttgaggaagaacatgctaagcagagggaatagtatatgcaaacattctaaggcacaaaagaatttacaaattcaagaaagtgaaagagggtctcaaagtgaccacaccacagagagagaataattgtacatgacgaagttggagtggtatacaggggtcaaactcttagcagtttaataggtccattcccccttagcctgccttttactactattaagcaccccttcatttaccttcacatgacttgttacaagaacttcagtacgaaaagcataagaattaagtaaagagagaaggaaatgtggctcttgcagaaagagcaagatgcatctggtctggtcatattgtttgggctgccattaaaggccagatattagaccaaagggtccaacgtttccacagagctgctcagtaaactaacatatgaaagaccttgatacccagcttgtgtcttgcttgccaaagatgaaagtaaactgataccctggcaaaaccaagaagtctcagaagcccggcctctatttttctagcctctactttcagatcacttcacagttattcagatacctccctggtccatacttctttactatatcaaaacaagaaaggacccaatgacatccaattatgataatgatgatagccactaaaataataattaacgtgtatcaagtatctcctgagtgctaagagttttacatgcattatctcttttaatcttcatttaacatccttgtgaggtaatatagtactagtatttccattttacacctaagaaatttgaaggtcagggaggctaagttatttgcctaaggttacagagcgaagactcacaaactctgtctgagtggtgaacccccatttttaagtactattgaatattgtaactcttccagatagtgaaatatacagtcaggtacctagaaatttggcatatgcagtgcccctaaaggtgaatatttgcctgaatttttcacctgtatcctgatgcttggctttatctaggccaaactgaactgtggcttgtacaaaaatatcttccccttctcaaggcattgctttcatgctctaatttaggtttttctcaaatgaatttttatttgcattctggtttaagaatcaagtccttaaacttacacaaactaccactttgatctacagtatccttggagagcatagcatttaatcagcttcattaagtactttgaattaagtgatatgcagagaacagcttgcctttaatagatctccttacctgatctcaatggggccctgtcttaggtattaaacaggagaaacccaattagttctagttgttgctctccatggatgtgttgccttctcattggcagatggcagctggtgttgtgaaggaagcaatgacccttaaattttccaggtggagacagccctccctcttcttcttcatgacacttctttttttcccccaatacttcatacaatccacatatctccaagacctataactccagagtttgtgatctcctcaacagaggccagttgtattcccagaccacttgataataccttggtttggcttagttgaacaaacatttattgggtgcaggctccgtatctgagaccatgttggtgttccagtggttagacaggagagttttgaaattaaagtcacatgattcttattctttttgtgcctagaagagtactaaccagtcagtgtttttgcttaaattgatatttaacatacttatatgttacatttatatttaacaaatatttcaagtgaatgaatgaatgctttaggtcccctttccaagggttcaagataatgctgcttcctgacactaagaggaaattctcaagattctccacctgtcaccacaaattctgctgtaaaatttgctccaagacaaatatcaaacttctagaaccggaattatccttaagacattaagtagttcagcctctgcttcaggcaggtgaacaactactctacatgtaggataaacgtcagcatgaattcattattaggtgaagaggcaggcataaattcaaaaacttactgtacaatgtaattggtgtaaaatataaatatgtacaaagtgctttaatagcataggaaaaaatagggcctaactttagagggatgttgaaggatcagggagtgcttcactgagtgtgtgacactttgatatttgacgtttgatattttaaggatgaaaaggagttaacgtgagaaaatgaggcagaggcaaaagtagaaacagcatgtgtaaaatcacagagtcacaaagaatatgagacccttattctgttcctaattgtgagtcattgtggcagaggttgattaaacgccagagggatgcagtcatgttttcctgataggaagttcactatggtgataatgtaagaaagagcccagaaagccattcttagttcatgccagccccttgctagcctttatgattgctatggatggaaaagcatcagagatacagctagcacttttctcccttgggtttttcactctagaaatggaaacacaccaagttattggaaattgttatgctcagtggatgttgagctatgctgtgttggatgatagcacaagtgttaagtcaaacatctatgctatacactttttttttttttggcatttaaggcactatgagggaagtatagaagcagtaagtgacaagatccttgccctcagagctgataacttgcctgtgagagaaaagaagcttcccaagtatctagaagtgcttccacactggtatataaatgtgggttgttgaacatttctgctttttgtacaatttgcaataatttgttaaactttgattacttttcaataggtaatttatttacataattcccacctcaaaaggtacacctcccctctatttagtttctctaccaaaaggcacccaatatcaccaaattcatatatttctttctagaacagtctattaatctataattaagttttaaatatttttcttttactgtttttgcacaacttgtgccacactgtgcacattgcactaaccttgtattttgcacttgcaatagattatggagatctttccatatcaacacatgaagagctgatttgttcttttttgtttgtttgtttatggatgtattatattccattgtgtgaatgtgctttaatttattggactagttaggttgtttttaatcttttgttcttacaaataatctttaaaaaactaattttaatcttaggacattttttatctcatgcattttcatcaagactttaggtgaagaaaggagagagactaggatttaaattgcattattttattgtattactttttttcccttcttctcacctcacattaacccatgttcccctatagaaagttatctgcagtaatgtcttctatgatccaagaaagccattttgggcaatccaagattgtgggctccccccatttagtgaaaagatcatgggtttgatgttaggcaaaccttgggatcaaattcaaattctggtttcactattttctagctgtatggtctttagcaagtgagttaatctttgcatctcagttatagcatctgtaaaatggggataataacagtagctacctcatggtgttgctgtggggatttagcatgacaatccatgcaaaggacttagcatagtgcctgtcacctacgaaatgttcgacaaatgaacatttaacactcttcttattcactaatgtggagaaagttgatagaacaaaggaaaactcatcaatttcacagtaacgattcttgacactatagaaacatttccacttttttgaggtttttcagaaggtgccaaaagccactaaaaatttcaaactctttttggaccagttatatgttccttattgcaccaattttctcagaactaccttcccatccttgttccttaaggtgtaaatgatatggttgagggcaggggtaagcactgtatacagaatagaaagtaacttcaataagtcttcatacaagacttcaataagtcttgatgggaagccataaacaatgctcagtaccccataatagagactaactacagtctgatgggaggaacaggtggagaaagccctctgctttcctgtggcagaaggaatcctcagaacggcagtgatgatgtgatcataagaagccagggtcagcaggaaggggccaaggacaaataaagaggtgcatataaaagaggtcatctgagctacttcagtgtcagtgcaaaccagtttcatgatgggcttcaaatcacggaagtgttcgaccacattggtggaacagaatgttaagtgaaaaatgaggacaatgaggagagtgaatgccagaaatccagccacccatgaggcactagctagctgtaagcaactccagtggtccatgatgctgaagtattgcagtgggttacaggtggctatatagcaatcataagacattacagccaggaagaagcattctgtagccaccaaggcaaaaagtaaaactgggaaacacaggctagaaagtaaaaaggcatatgagctgatggcagtcctcagcctcatgggctcaatggtactggtgcagccaatctctaggaagaagtgaccaagaaagaaaaacatgggcgtgtgaaggaaatgattagctgacaccacaggatcgcaatgttgcccattacagtcaccacatagatggccagaaatatcccaaaaagaagaaactgaaggccatggagatccccaaaacccaaaaagataatttctgaaatttgaatcgtgttttcttcttcagttccagccatgatttggatctaaaaaaaaataaatatttgaagaataaccattgatctgatactttttttagaaaaacatcaaactgctttaaagtgtcacacataccgagcataattggcttctttctggaagtccaggattattacacttaattaataaatttgactccagtcctccaggggccatttggaaagttaatccatgacttcaattatcccatcatatttagaatgtatagactcttaaaactgtaactgtgacacataaatatgtacattttttccaatatgtattttggaaaatgctcgatcctttcagatcttaactggttgttcctactgctgtgctggtgttatcatcaacaatgaatattcctaattacctgtgtgtaaatttcataagagcaatgattaaatctgtttcttgttttagaaattctataccaattgaattatatttttatttgtggtaaaattatagtgctttatttcatcataacaaaggatgtctaatccttaaacttgtttgatagaaaattcgttaaacattagtagaggaggcacagaagagcaagggtgaactactgatggtggggagatggtatagcatagcggaaaaagacatgcctaaagtcaaatcccagctttgccacttactggctgtgtaccctggagcaagtcacatcacttctctgaaagttggtatcctcatctatagaatagtatatgaattcgatgtaacacattttgcacaattactggtccatattaggtactcaatacattcattcatacattcaacaaatatttactaaatgcttactctgtgccaactcttaggtgcttagaataaaatagtaaaaaaagtcaatacttttttaacacatcaggaataccctctacatttcatggagttagcatttcagtgagagagaaagaagaaagactaaaaacaaggaaagagacccataaagaattgtgaattgtttactatgaatgtaaacaaacaaggacccaaaatataaaatatgctctctctgtgtgtgtgtgtgtgtgtgtgtgtgtgtgtgtgtgtgtgtgtgtgtttgggagaggggtattttgttcggagtggccaagaaaagcctaaaaatttgagacctaaaaaaatgggaaggagataataatgcaagaattagaagtgggggtgagggagaacattctaggcaaagggtataagccatgagcatgcaaacattgagtgttagaaaaactaatataaacttaaaaagaccagcatattgtggagagacagagaagagagagagagagagagagagagagagagaatgagagaagatagaaaaaataggaagggccagatcattcaggttcttgcagatcatgctaaagaatttagatgtttttaaagactgtaggaatccactggaggatgttaagcagtagtgatgaaatttacagctgaaaatcatgtttcctgctatctgataaatgaattagagagagaacttcatgggtagagtaagacaattaaaaaactacttcagtggaacaggtaagaggtaatagtaaacctgaataatgttgttgcagaaaagatagaaaaaagagagattcaagacatatttgggaggtaaaaatgtcaggacttactgacatatcagatatggagagtaatgaaaactgactatcagagatgactcatgggtttctggtttgagtaagtggtgcaatttacttggatagtgagattatataaaaagaaaatttaggggaaacataaattcaatttgtattgtttgaggtgtccatgagaattctgggtaaaaggaagaaacagacagctagatttgaaagtatgtagcccagaagagagggctggactagggtataagtttaggagttatctgaatatagataacattgaaatccatgggaatggagatattatagataaagaagtatgtgctgcactaagctttaagggtctctctcgaggtgaggggcgcctctgcccggccgcccctactgggaagtaaggagctcctctgcccggccagccgccccgtccgggagggagggggggggggttagccccccgcccggccagccagggagggaggtgggggggtcagccccccgcccagccagccaccccgtccgggaggtgaggggcgcctctgcccggccgcccctactgggaagtgaggagcccctctgcccggccagccgccccatccgggagggaggtgggggggtcagctccccgcccggccagccgccccgtccgggagggaggtgggatcagccccccgcccggccagccaccccgtccaggaggtgaggggcgcctctgcccggccgcccctactgggaagtgaggagcccctctgcccggccaccaccccgtctgggaggtgtgcccagcggctcattgagggcgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattatcctatgaccctgccaaatccccctctgcgagaaacacccaagaatgatcaataaaaaaaaataaattaattaaaaaaaaaaaaaagagtctcccttaggtctaacagaataggagaaggcaggaaaggagataaaaaaggaggattcagtgagattggatgaaaaccaggaggaaatcaaataacagaatccatgtttcaagagaattgttgactgagttaataaaagctgttgtgagattaagatgaagacaaaaaacagtctcttacatttagttacaagaataatagatttagtagagtgatgagtgatggggactgaaggggagcagagaaattgggtggtaactatagagagatgagcattaaccctaccttttgtatgctgatgagaatgacccagcatagaggggatattgatgatgcatatgaaaataagaaataaatttttggagcaaaatcttttagaaagtgagagaggatgggatacagaacacaagtcaaggcattcacctttggtaaaagcagaaacacttcatccttttaacaggaggaaagccagagaaaacagatgccattgtagataagttgcaacatttaatcttaggaagatgactgagtttgcctctatggcttttgtttcctcaatgaagtacgaaaaaaggtcatgatataagagtgaggggtggggagggcatgttgggagtttgagggcagagggaaaactaaaatagtcatatctggaagtgagaaggctttactacttagaacaaatactatgattttcgggtaatattgagaggaaatttgatcattgaaatcatgaatttaagaaggtgaaaccagattgctttcttgagtggtcttctttggcaatgtttagctaacagggtagagtaagtagatatcgttggtttaaaatcaagtttgggatttgccaagttaaaacaatggaagaaaaggaggacaagaaaattgagatattttcacaaaaaaagtaataatgaaagactacatgataaatatgaggtctttcccacttccactgattatgaagtcataggatattaaagacggaaaggacttttaaagtttcatttgataaacgcttaagttttataactgaaaaagaagattcaaagaggtaaagtgtctttcttagaatctcagatccagctagtaatggcaagaactgacacccaagtctcattttccagttcttgctccttccattacaacatgctgtaatattttttactcacttttcatctcctttcagtgccctgaacaaggatcttaatgtatactacataagtctgtgaaggaagacttacttctcttttagtaatttacatgtctggagcataatacttttcaaataactttcagatccattattatttttaatcttccaaactatcttgtgaggtatttgagaataggtctttgatttgtctcgctgaatttacagatgagaaatctgataatgatgattactacagcagcacattgtacttgtatttcaattttaattttttttcctgaagataaaaagttaatcttatgcatgttgatgtaattttgaatttacaagatgctaattatattacgagccaggagtttttgtcaggtaactggataataggagccatatggagattaccaccatctgaactgaacaacaaatgaaagaaattgaggtagtttccatgatggagatgtaacaaaaaaaacttgctttaggaaaaaggggtttggagggcagaatgaaataaactgtttcagagccatggtgggtatctagcaaaagtagaaccttcttaggagaagaagagagagaatattccatggagagagaataatggtcaaaagggtccagtaacttgaggaccatgtcagccattgattttggagtgtttggacaaaatgagtagggggcagatgacaggaaaggcagggaaactcatatttttttggagaaaaaaagactagaaagattttccaaaattgtgtcatagaagtgggagaaacagagagtgatgtcatagagtccaagggagaagtggagccatcagaattgttaataaagaaggtgccatgaatattggagagctggggcaagaatcccaactgaagtgaggttggtggtggggggataaagggaaaaacaacaaatgtgggttataatttcaagaagattgttgatgaagtaaaggaggcagagagagcaccaaaaagctaagggtggaagagaggacagagagtatttttattcttgtgttttgggtcttagtgaagaagaaacttggccaagatgctacgcaaagaatctaggtccagagagaaggaaatatgaaatacatgcaagaggatgaatgatgaagcaaagggagtctctgaggaggttggaggggacgggatggggaaatacacaagtggaggcgttgtcttcaggcagaaaagaaaggtcatcatttaggaaaaaggaaagagagtaaacatggatgtggggattgattatgaagataattacctcatcattttccttccacttgagtttggagatttaatgagcccatggtagagatgttcactttccttccttagagcctggcttcttattccattgatatgtgtgaagccccaaatacttagcctccccaaactattgcttggagctttcagcagcctctggaggccctggcctagatggatcgtggctccgacccatgtgacatgtcagataccccagtgtccaatttcacaccattagtcagcagtcactgaatgctcagtcaggatgtcatgagaacccaacatcgatctctcacttaaaaagcaaagctcccctgggagccaaacttaaagataattggttttctagtggagcccaaagtgagttgctaagacaagtagctggttagctgtaccactactgtgttgtttgacctgaagtagatccagcaacagcatgacagattatcttattatatattctttacaaagatcactcatgaccttaacaatcatagtttcccaatctttcctttcatacctgcacaattattattttctctctgacttccctggagctcaaaaggcttctacaaggaagaactaagagtatgtcacccaaaggcacgtttagttttcacatggtagtggccgaagcaattttagcccctacagcgcctcctttgggtttagaaggagcataatgcttgccactttatttatcttttaagcgctccaacaaccttctgcaagcagggactggcacatacagttcaaacaagaaatccaattatctttaggtttgtctctcaggggagctttgctttttaattgagagatcgatgtcaggttctcatgacatcctgaacgtccattcagtgactgctgactaatggtgtgaaattggatattggagtatctgacatgtcaaatgggtcagagccacgatctctctaggccagggcctccagaggctgccgaaagctcagagctatagtttgggaagtgtaccatgtgagaagtactgaaactagtggcaaaagaatctaggttctagacctagatctcccactgcctgtgcaatttggtgtcacatatcttcacttagtcccagtttttcttgctgtgaaagggggcaataactcctgccttgctgacctcacaagtttattgtaggactcaaatgagatgctgtatgggaaaccactttattaactacaaagcttcatgcttcatgctaggaacatacttgatgaacatgagaattatgttgctgacatccacagaagttgaggatagttttgtcttagggttcaaagaggcctggactcctagaactggaagtagagctcttacttttttacatcattaaatataccctaaaacatccaaatccccttacctcaaagccttcagtcaaccttaagtgaattgcacatctaattaaaagcacaactgttatagtttggtttttataatcaaattaaaagtcttcttacacaagctgtcagaggcagttttctgaacagttaccttgtcatttttccatccttggtagacagattgcatctgacctcctgggtaagtttcctcagtgctggttttatatgctttcactactttccaggctgtacagaaatggttggggagtggaacctttccttagagctcttagtgaggcttctctttctttgatggctgtgtgagcatcctgtaaaacagagtacttgcacagatatgactgttatctctgttatctcagaacatcaccattgtcgccattcagttatagcattcacacacaatatcaggtcactccactaggtcaggctcaatgtctagcggaaatgacagacatgtaaatgaacaatcaaattgcaacatcacaagtgcaacaacaggactctttataacatgtaggtgtagcacagagaaaggaatttccggatcagtttgcagggaggtagtgccagtgaagacctattggagaggactgccattggcattgttcttgtttatttccccaaacaatttcccatttattattttattaatctttatgatgccttgggttttgaaggaggaatagaagtatgttaaaccaactagagacagaaagagtttcagtcagaaagaatagcatgtgctactaagaggcaggagagaaaactagagaaataggcaggcaccagatgatcaggagctgtgtacaccatcctaaggagtgtggactttattgtgaggtcagtgaagagccattaaagagtttcaaatcgggaagtggaatagttatgtttgtgttttattttttactttaatttttaatttaaaattttttgtgggtacacagtaagtgtatacatttatggggtacatgagatgttttgatacaggcatgcaatgtaaaataatcacatcatggggaatggggtatccatcccctcaaacatttatcctttgtgttacaaattgtccaattacactcttttagttatttttaaatgtacaattaggttattattgactatagtcaaccccgttgtgctatcaagtaataggtcttattctttctactttttgtacccattaaccatccccacctctccccagccccgcactacccttctcagcctctgctaaccatcattctactcctatgtccatgagttccattgttttgatttttagatcccacaaaaaagtgagaacatgtgatgtttgtctttctgtgcctggcttatttcacttaacataatgatctccggttccatctgtgttgttgcaaatgacagcatttcattcttttttctggctgaatactattccagtgtatatatgcaccacgttttctttatccattcatctgttgatggacacttaggttacttcagaatcttggctattataaacagtgctgcaacaaatataggcatgcagaaatttctttgacaccctgatttcctttattttggaaattcctcaaaaaactaaaaatagagctactatattatccagcaagcccactgctgggtatgttttgttttagaaagctatatacttttggtggctatgcaaataagttataagtaaaggaaaagatttgaggcaggcagttcagtgagaaggttgtggcttcaatctaagaaagaatggtggctattgggaagggagaggaggaaacagcttcagatggtagttatatcactgtcattgtcactaagaccatcttctcctttcattacaatcaactttatcaaatgcaatttctggaagaaaatagttttactgagtatcccctaatatacagatggatcgtaaccctgaaattcgtatgcgatttggttattctatgtcaactcacatttcccatagaaataacagcaatcccaaatccctggccatcccagagaaacccatagagagcacaaggtgcttgaaaaatggttgagtttgcagtaaaatatagttgttctgtagtaacatttgttgtctgaatgcataggtgaacaaattaaggaataaacacatgagaatagtttactagcacaggcaaggctctgtactagatacagtgggagatgcaaggatgtctcagatataactcttaaccttgaaggaaatgagaaaatctttcagcttgtcaacccctcaaagtgacatctcctgcctaattgtcagcttgctggtctttaagcttcaaaattaactttgattaaaagaaaatccaataagtgtcatgtaatgttccatatgcaaataatactaacctaaagatcacacaaggtgtcgtctttgattttaagctcatgaacttttaaaaaactaagttgaatgcacaatgcataatttgcacgtggtgaataattaaaacagtataactaagcctccctccaatcccagacctccagtctctctctctagaggcaagtactaaaaacagtttgttgtgggtgctttaagaaattttgtatgcttataccaacgtttatatacatttatatttttccatatttatataaaaatgatcatactttttcacttaatatattttatggagctttttcatttaatatatcttggtgatttttctgtatctgcacatagagatcaacctcatacattttgacaattgcatagtgttctagcatatggatgggccattatttatttatttttagttcagagcttgttttctgagaaataaaacattataggtacagtaaaatttcctttcgtccccaatcccatgtcttctgagctccgggggcaaccactaccttaaaagacgatatgtgtcctctatgttcatgttttttatccttctattacatatgactctatccataaacaatatgtggtaatattacatctgttttaaattttgcacaaatgaaataatagttttttgcaacttgctttgtttttctatttcacattttgtttttagacctagccctgttgatacatacagttctcattcattcattgttgatttaccttgctcctcattatactgaatactagtggtttgtttgtttttccttatagcatacttgctaaaaataacagtcttacaagtgtaattatttttctcagatcctttctttgaggttgcactggatacattaatagaagtgtgggagattcttataaattgaaagagaaaataaattgaaaacatgaaaaaattttggtggtagaaaattatagacttttttatgttaacatattttagccagtacaagtgttgtaaggaatgtccttgaacttgtttccagtatttctttaaggtacctaagagttaaattgctggctcagagtgtatacatattttcagtttcactaagtactgccaaattctctaaagtggatgtataaactcacattcccaaaagcagtgtataacaatttctgtttcctcacattcttgttggcatgtggtattagcagatgtttttatttggggcaatctgatggctatggaatagtatcactatgctagtttaatttgcatttccttgattatttatgaagataagtatgtttttatctacttactagccattcagattttctcttctgtgcattgttcattaatatattgcccactgttaatttaggttggttgttttttaactaaatggagtactttatgtcgtccatattgatttgttatatatttgttacaaatgtcttctctaagtctgtcacttgtctattatctttatcttataatacagaaagacagaggctttatttccctatcaatatgctctaattaatctgtaatttacaatttgtgttttttgtgtcttattcaagaaatcctttcctacactgagatcatattattctaagtatcttttaaattttaaaagttgtttttaagatttagtttttaaatccatctgaaattgatttctatatgtgatatagtaatctaattgtattttttctgatttgaataaacaatcattcttaccccatttattgaataatccatccttttctcccatgatttgcaatgccaattctgtcatataccaaggctccttatattctctgatttgtgtctaggtctttcctttctcccactgatctgtttgtgtctctctgcataagtactatactgtttcaattattacagttttctaagtcttgatagctgtaggacaagtccttcctacttgttcttcttcataattatcttgaatattcttggtccttcaattactcatatgaattttaggatcagcttgttaaacctcatttgaaattacgtctggaattgcattaaatttatagattagtttttgggacattggacatctttaagttgagtattgctatatctgaaaatggtaggctgggcacggtggctcacacctgtaatcccagcactttgggagcccgaggcagacggatcacctgaggtcgggagtttgagaccagcctgactcaagagagagagagagacagagagagagagagagagagagagagagagagagagaaagggagaggaaaggaaaggaagaaaaaagaaaagaaaagaaatgaaaatggtatctatctcccttaattaaggtcttctttaatatccttcagtaatacatacaatattttccataaatactatgggcatcatttgttagacttatgtacttaatagtgctgcttcttattgtgaatgggagctttattttaattagctttattgaggtatactttacaaacaattgattttatgagttttggcaaatgtatgcaattgtgtaatagtcattatgatcaagatgcagaacatttccaccactccaaaaaccccattctccttgaagttagtctcatttcccattgagtccttggcaatcacttttatgtttcctgtcacaatactttgcccttttctagaatttcatataaattaagctatatgacatataatcctttgtgcctgttgtctttggtgcagcacaatgtttttgagactagtctacctttttgtttgtatcagcagtttctttttgtattgctgagtagtattctattgtatggatgtacccaagcttgttgatccattcactagttcatggttgtttgcagattttggctataatgagtaaagttactatgaacattcacataccaagtctgtgagtggacatgctttcatatctcttgggtaaattcccgagagtgggattgctgggttatatagtaagcgtatgtttaactttataagaaattgtcaatcgcttttacaaaatgactgcaccattttgcattcccacagcagggtatgcaaattcttgcagttttcccttatcctgaacaacacttgatattacaggctatttattttatttttagctagttaatagtaactttctaaaaagttatattttctaattgcttttctactgtttaagaatattattgatttttaaaacatatctcccatgcatcaatattgatggactttcttaacagttaaaatagtttttctgaaaactctttttagctttctatgtagtcaaccaaattattcatgaataatgacactctcgtcctttccagtgcttaaatctatttcagtttcttgtcttaatgaaataacaatgatctcatggatacaatgttagatactagttttgagagtagatatcttgtcttatgactctaatgagaatgctttttaagcttctacattaattataatgttaattataggtatttcatatatatcctttgtcagattaaatgcttccctctattcttgatttgtttacacttttttacaatacagaagtgttgaattttatttaatttttctgtatctattgaggttagtatgcattgctttctctttaattagcttaagcagtgacttgtaataaattttctaatgttagactgtcctttaattcctggaatcaagcttgtttggtcacactgtattttttttgtagatttgctgagttcaattcactaatattttaattaggactttttaagactttttatgaagaatgatactggtgtataatttttcatctttctaacaagtttatctggttttggtatcaagatttcactagcctcataaaatgggctgggcacattttcctttttatctgttctcacaccagttggaatggttattatcaaaaagtcaaaaattacagattttggtgaggttgcagagaaaagggaatgcttataggagtgtaaattagttcagcccctgtagaaagcagtctggagatttctcaaagaaccaaaagtagaattaccattcaacatagtaatccaactactgggtatattcccaaaagaaaataaattattctacccaaaatacacctgcattcacatttatcacagtagtattcacaatagcaaagacatggaatcaacctcggtgcccatcactgatggatcgaataaagaaaatgcagtacctatacaccatggaatactatgtggccattaaaaaagaatgaaatcatgtcccttgcagcaacatggatgcagctagaggctattatcctaagagaattaacacagaaagggaaaattaaattctgcatgttctcacttataagtgggagctaaacattgggtagacacagacataaagatgggaacaagagacactggggattccaaaagttgggagggaggaaggaagggaagggttgaaaaactacctgttgggtactatgttcactacttgggtgatgagatcaatagaagttcaaacctcagcatcacatttaatatacccacgtaacaaacctgcacaagtaccctctgaacgtaaacttttttaaaaaaaattaaactgaagaaaaagaaaaaaaattatgctttggcttgataaagcatttttatttttgttattgtttcctattttattaacttccgtgttgatatttatttcctttctttaactttcttctggttggcttcctggttattattctaacttcttgagttgaatgttcagcatatgaatattcagttatgttgtttcatatttcatggatcatattttcttataaatatgacattagttgcaccctacaatgcagtatatgtcattaagtaatatttataatttccattatcttttctttattttgtttagaagagtttttgtccaaatttatggaaatttcttagattaaaaattatttttgatattttcattaatttctatcttatcaaagtttgattaaaatgttattaatatgatagtgaagtagcttcaagtacatattcacagtacttgcaaagtcatcattcttattatgaacagcatatatcgaatgtcaatttgtttccaggcaactaaggtggttacacaggtctgagacatgttggtccttcactcaaggcataaaatctagtaaaggaggcaaaataaggatataagaaaagtaaaatagaataaagcacaataggagtatagaatgattgcatgctgtaatcattggtcctaaagttccaagaaaagagtgtttagaatgttcataaggcagcagtgtggaggatgaataaataagggacaagtttggaggcagtgagactagttaggaggctactgcatagtccaggcaagtgacaaaatagagaaaagcctcctctcggacagaggaatctctaacaaggaagccagcagcaggaagtaagatcctctagtagtggggctagatataccctacccacctaagtctggctgcctttagacttgaagctacttcacttagacacacttgcttagattctgcccaaatgtaccctggcatgagttttgactcaggaagtaatttcctgatggcctctgtcaccaagggctcaaatttgctggtcatctggtcaatctgaaaagtctggactctagacagagaacagagtaaagccatgggtcttggtctgcacaacacattactcttaccacaactctaagtagccatatactcaaagccatcttgggtcaaattagggaaactaggaaccagttaagatccttttcacaaatggtggtaaatagtgaggtctataaagaaagttactgtagatatcagccctaggcaaccatctcctcatttcctcagtgtcttttacttctaactatgccttccgccctgctctagacaaaccaggcctctatgcatctaaatccttctatctcagcctatgatctctatttcccctttttctcttcactactcatctccaagctgatccctcttcactttttctagattttattcaagccacctacctcttcataagtactctcttatgaacccaatctatcttatgtccctcctcatgagtcccagcctcacagtttaaatctaggaggtgcttgctggttggcacttcaataatccaggaggtgatacaccagagtggaaagaacatgagctctttagacaaacagatctggattcaaatcctgtattcaccattcactagctgtgtgaccttgagtgagctacttaacccttcctaactacagcattctcactggcaaaaatggaagaaataatagcaactacctcacagagttcctgggaggattaaatgagataactgatttagcatttagcacataaaaagcattaaatccatgttaaataaaaggtcatagttcagctttcttatgggtgggatcttcactagtccctaaatgggttggaagttgacaaaaggtagtgaccacagctttcttcttcctcatccctcttcaactttgcatctggtgtagggttttgtatacaataggtgttcaatttattttgtggcctggttgggcatgatctaaagccgcatgtaggaaccaactatgggaaagggagtgggtcttaggaggctgaatttattataattggagagtctggactgttaattctcatgattaaaaagagaccaggatgattgtcagggatacagatacatgaaacctactataggcaaatttctcagagggaaaaaatgtggaaatcatggaccctaagagtatggagagagggtggcatcttgccttatactgaaacagggatatgtaatataaagggagttacagagtcaaatagtcctgaattgaaatccaaattctactgcagagaatttgtgcgaccttgggcaaatcaccaaatctttcaaagtctcagtttccccatctctaatgtggagataataactcttgacttctagagttgtgaagaaaattcaatgcacgacctgttttaaattcctagaataatgtctgagacacatttggctaccaaaatatatcacttccatctctttcccttcccttaccctcctttactattttggacagcgtggggacctgggcgtggggaaggagaggaattgtaaaccttcatgaggaagtcccaaatgttttcttcacatccttgttcctcagactttggaccatggggttgagcatgagaatagccactgtgtaaaacagagaccagcatatctctgtctggtgaacacttcaaggataggtgcaggtgaaggaacactgtggttccatagcacaggctgactgctgtcaggtgggaagcacaagtgtttgcctcaaaccgagggcattctcataattaaatggagacaaggaagattgtccgggacaccgatacattaaagctactagaggcaaaggtaagaagttgaaggccttgcatgtcagagcaggagagtttttaaagcctcggtgggggaggaaataacagaattaatgaatgatggcacagacttacagaagatcagatgaaagattgtgctactagggagcaccatgttcatagctggtggccaccagctgcaagcagagctttggggacatggtgatatggtagagcagaggattgcagacggcctcttagcggtaatagaccatggaggccaggaggaagaactcggtgtcagcaaatattttaaaagcagcttaactgggccatgcaaccagagaaggagaagacttggcagtcagaaaagaaccccattgatatttttgggactgttactgaagaataacagaagtcaacagaggaccagttgctgaggaagaaatacatgggggtgaggaattggggactgaccacaatgaaggcaaggaggcccaggtttccatcaccatgactacatagatggggaggaagagggcagagaaggtgggatgaagctgaggatcatcagtcaagtccatgaggaagaattcacaatgcatcacaatggtgagacacatagagctcaagtctttaaagagagacctatgggggctgggccttgctttccaggccatgacacgtcatatgtgtttactatggcaagtgctgcatctggctcactcttctcttgccaccctccagcctattggctacaaggtttaaaagcatgaggatgaactttggagtcagaagaatggatcaaaatctcatctttgccacttactatctgcaacctagggctgctatcttaatctctctgagtcttctctgtaaacagggataaaacacctattttgtaagactggttgtgaggattgaaggtggtggtgagtgtatgtaaaatgtctagcatggcatgagaagaagagcaggtttctcaatgagttctaattatctttttctttccacactctccttcatcccaacattgaacctgtcctcaggtaatgcccagcctaaacataaagtcaaggatacaaatattacacataggaaggaccctagaaacttcttagtcttttcattatcatatttcatattggttggcagggagcagggggtaggttgaagggcaatatcaaatactatagtacagaagtaaaaggacaagctcgaaggtcagccatgtgtgggttagaatccatttctaacttgctagctgtgtgaccttgagcaaatgacaacctgtgtgagtttcagtttcctcatctgtaagatgcgagtaccaagtatttcctatttcattaatttactgtgaagatgaaacgagattatttgtgtaaagcacttagcaaagtatctggaaaaaaattgcccacagtttcccaggggggtttgtggagtgccagaaactgcaacccaggtgccctgactacagtattcttcaccctagggaccacagcctccgacttctcttctttcagaaatatggaacctttgtcctcaccagaacacagggggctgtttcacccatggtttcctaagaaatagcaatcatgaattctgcttaaggtcatgtctaccctttctcttaatcaaggagaatgccaatgtactttataattttttttattatactttaagttctagggtacatgtgcacaacgtgcaggtttgttacatatgtacacatgcgccatgttggtgtgctgcacccattaactcgtcatttacattaggtgtatcttctaatgctctccctcccccctccccccactccacgacaggcccggtgtgtgatgttccccttcctgtgtccaagtgttctcattgttcaattcccacctatgagtgaggactgtactttatcttaatgttttttttctgtcagaacgtggggtagggaaggacacactatagcactgcaaaaaggttttatatcattggatttagagtcagaacacctaagtttgagttccgatatatactatttgagctctatagtgcttagtaaattctatctgagtcataggaccttcatctgtaaaataagaataataacacttgccctctaatctcacaggtttgctgcaaagatccaatgaaagtctctagaaaaatgctttgtaaactataaatatagtcagagcagatactcagagagtattactgagaaccaaatcacctttagaaaactttcgatgacaattgttaaattactgctcttcagccctctccttcctggctgcttccctggtacctgccagcccattttggatttcataacactggcctccatcttcttctgggctcctggtcagactatagaagataaaattagattgttctctggaaattttgggtgcccctgtccctctgagtctgtgattgcctgtttttggttggtgttctattacagtgacctttacggctgcctttggaaagtgaagtttccacagagtataatactggttgttaaaaacttacattttatcctgaatgtagaaattgctaccattaataaagtacctaataggtgccacacattatattgggcaattgccacaaatcattttatttaataatcctaacaaccttaagaagtaattactattatcactaccatctttcaaaccaagcaactgagacttagaaaattccagtgccttactcaagggctcatagctgggtgcatgtcagaactgacatttaagcagacgtctgcaacattcgaatactattgttttacccatgttgacttttctgaacatagtgtcatacacttaaggattatgaaggtttttttcaagagatttacaaatttatcctttctttttatcatgctaatcttggaaataatcaagtggtttctattaattttacagatgatcaatctaagctacagaaagttaaatgcgttgtccatgggcatacatacattcactcattcaacaaatattcactgggtccttggtgtgtgccaggcagtgcaataggcactaggagtaaaggagtaaacaagactgatcaagtctctattctcttggacttcacaatctaaaggaagagatagacaacaaacaaataaagaaatgcttttacatctcaataaaattgcaaagaaagtaaaacaagctaacaaactagagagatctcagggtttcaagagcaacattaggtagagtgggagggaaagactgaggaggtgacattaaaagctgaaatctgaatggtgaggaactagccataaaaagatccagagtatgcataaatgcttagtgacgaagtcaaggatagagcccaggtctcctaaattctacacagggccactgttcccaattggaagtgtggccaaagtagaggttgactaggggtatggaatatgtgtgacattcaaactcttgtctacaagcattcctttcctttatcacccaccttccttctttgaatgtctctagaagttatgagtattcactagccactttcttgtttctgtactcatccaaaatgcttcaggccagcttcagtagttgggctttttccagatgttctcttggcaggcacagaaaagttcatgtgccacaacagtaaagcctctggaactaagctccaatgtataatccttccccatttcctcctccaggcttggccatttccctgtaactggcagaatcattaatatagcaaagtttctgccttcttgactggtctactgggatgcccagaaaagtaagcccaggggctgagcagctgtgacgtccaacatggctggagcattaagcagagccatccccaatggggtgttttcactgactcatactgagagtgtggggacctgtagtcaccactgagatgttttaggaacagttggaagaataaaattgagtatgagatatattgtgatataaactttttatctaaaatgccttcttagtcatattaaaaagtctcagccacaattaaaataccagctctcttcccaaacatagggattctaggatttatgtgcaaaatggccaatacagaagatctactaagaatatatttcattttatgacctctcatatcaccttgtttatgcaaccctttataaactgtaaattacttttaagcatcaaagaattatttaattagttttcatgaggtcagtaaagttcctcagtgccactcagtgttttaataaatattcttgtacttcgggtgtatgtggctgccagttgccttgtaccatccttttccatttttctcaaatcagatttgagttgtgcaagacttatttccatgcatttgctttattttgtcaattaaatccatgtttattaaccatctctcatgtacttgttattattctaggagccagggatacaaaatcaaaagtaaattaatttgtatctcctatgtacactccattttcactcctaagtacatgcctgcatgcacacacacgtgcataagtacacacacacacacacacgcacacacacaacatatacacacaaagtcttttgttttttgaaaggcaaaagcagcctcactctagtgctaggtcattagcagcttttgtagaaaatatcaagttattatgcattttaagggctcgagctattgattttaaggcaagaaaattgcttaaaaagtggactttataaacatctctcttgtggaccaattcatttaattctattgcttggttatgcagaattttgtagcccttttaagtagagaaattattctttttctcaagttaaatgtagtacattaggtgatatttgaaccagtttatgggattctgctgtggcatgatgagctgactttatgtattgaagaactctgtccccaaatttaattatcttgagacatcaccaccacataggataaaatgagccattttgttcattgcatcagcagcctttgctgaaatggaggtgatgggataacaacttaaaggctaactcattaatgctcagggatgaatgaggtaatgtgtcagcagaccaaattggtgcccaaatgttttcatctagaggcccgtatctctttcccgcattgtgatatattaatggggatgtcttgatccgttgtcgctgcctgtagacatttgaataacgtagaagtaataccttctgggcactcaggcctgtgcgctatcaatttttcaaactccaaaggtctctcagtggatagaagcaaaattctgatagtgccataaagtgcctaatttataaagattcaaaccacggcatcagtgcagtccctgcttttttctgataggtgttttctactgagcactgcaccattcctaactatttggtgggggtagtggagcaaattagtcctccaaattgtgaagcctgtggatttatgcatagttgaaaccatttccgttctagcaatgtctaagtgggtgacctttctgacgttaatttgtttctccatctgtgccatgcattttgagaggacgtgaagaataggcttgatgatacccaaatgcatttccccctattttgtattgctgtgctgatggcttgaaggaggagttacctatactggggacagattctggagatgtcctttcaccagtgtgcattgaatgaggccagaaaattcatcttcatggagcctggaacatggaaggttttactgtcctccttgaaatgaatgtcctctcttagttatgatgtcatctggccatttgctgtcccaaattaaattttctcctactcttccctggctcctgaatgtgttttgtgtagcttggaggttacaatttcatgttacatatttttaaaagatttattgagccagtcagtagaaggaattgtactaaatttaatcacaaaatttcatgttattcttacaacaaccctatgagataggtacaattttatttctattttacagatgaagaaagtgaaccagataaagtaaataattttcccaggatcaaatgggtggtatgtaactaagccaggaatgattattgaagtccttctgactgtacaacgtatgctatttctgccatagaacactgaaatcatcttttaagaaaatgtatttgccaatctactcagcatttttctttaaaatgaatagttctcaacactgggtgcacattaaactcatctaagagcttaagaacatactgtacacaggttccattttcagattctgctgtctggtttggggcatgggcatccatatttgtaaaaagtttcccaagtgactctaataaattaccaaattgaaaactgaatttagagtttggggtaatgagttccttttcctgtttcctgttcagaaggagcatatttagccctagttgcttaattcctcacaggatctgagcaagaatttgtagcttttactcaatacgacagtcagggagtggtcttttcacaatggctagggactgttatctttgcattctcacaagtgcctccttatctatagaatcttggccatcattgaaatggattgaaatagtgacctgcaacacaggacaaactcatggaatcttatgaagtaaaaggcatttcaggagtgactgtaggcaccatcttcatcccttccccacaaagaggttaggagagatacacgctctatcataattttcaaagatatgtggtaccttcattgagcggtactttctgtttcttttatgtaacaaacttttatcaaatgtatatgtaccaggcactgttagttgttcttggctgaggtgatattccccttataaaggatgtttggaattgtgtcgaattttttttgattgacaaaatgatcagaagaattattattaaaccacagctgtccagggatgctaaatgttccatagtgctcaggactgtcttgagcaattcttataataagagtgatttcactccacatggcaataacacctttattgagaaacaacaatagataatctggatctggagttcaacatgttgccccttcaaggacactggctacaatcaccatcatcctgctcccgctgaggcttttggaaggacttttccgtcagtttttcagtcagcaactatcaagtccttactgtacattgaagccttaacaggcactaagtaaaaggaaaaaaaagacagtctttctttaacttcagagagcttacaatctaagtggcaagacaaaatatacacttatgaataagatgaagaagattccctaaacaacatgccagctagtacatataccaagccaaaagtgggtggtataatgaaaagaacataatattcagagtccaacagaacttagatcaaatattggtctcaaagtcttatttttgtcctatcttaggcatggtactcaacatctctgagtggcagttttctaatctgtaaaatgaaatatttaccttgtagcatttaaataagtattacaaataatgcatgtaattatctagtacagcactggtaacatagaaagtactcagtaaacaacattttctgttaagatcataatataataaaatgtatttgactgaataacatcatcagctaagtggaactaattgatatttgtagagcactccatccaacaatagagggatacatttaccaaaataggctatatctgagatcatacaccaaaccataacacacttgaaaataattgaaattacatatagtatctgaccataattgatttaaactaaaaagcaataagagaaagatagcaaaaaaatctttaatcacttggaaattaagcaacatcctcttaaacaatccatgaatcaaagaggcaatctcaaagggaattagaaaatatttggaatggagtaaaaaagaaaatataccatatcaagaaacaaaagataacaagcgttggcaaagatgtggtgatactgaaacccttgtacactgctgctgtggatgcaaaatggtgcagccactataaaaaacagtatgggagtttttcaaagaattaaaaatataactactatgtgatctagcaatcccacttctgggtacatatacaaaggaaatgaaatcaatatgtccaagagatatctgccctgtcatgttcattgcagcactattcataatagccaagatatagacaaaaccctagtgtccattgacagatgagtagataatgaaatgtagtagtatatctatgcaatgggatatcactgagccttaaaaaggaaggaaatcttgccatttgtgacaacacggatgaacctggagtattttggcataatgaagcacaccaataagttaagtggcatatttcgtgagataagccagtcacaaaaggacaaataaccatgtttccacttatatgaggtatcgaaaatagtcaaactgatagaagcagagaacacaatagtagttgccaggggctgggaggagagaaaaatggggaattgtttaatgggtttaaaattttatttatataaagtgagaaagttctagagatttgctgtacaacatagtgcctatagttaacaatacaatatcgtgcacttcaaaatttgttaagagggtagatctcatgttgagtgttcttatcataacaacaaaagcaaaaacaaagggacacaaagaaactttgggaagtggtggatatgtttaataccttgattgtggtgatggtatcattggtgtttgcatatgtctacattaatcaaattatgcacattaaatatgtgcagtgctttgtatatcagttatacctcaataaagctgttaaatgataaaattttaaaaaattaaattaaattaatagaacagaataaaagaaaaaagagggaagggaataaaggaaggaaggaagagggaaggaaggacatactgatagaaaaggaagaaactgtctctatttgcagacaacatggttgtctatgtagaaaatccagggaatgtaaaaagaagacttcctagaactaataaatgagttcgcagtgtcataggatgcaaggtcgacacaaaatttaattgtatttctaaatacaagcaatgaacaattgagaatcaaaagtataacaatatatatgcaccaccttttaaaatggctctaacaatgaaatagttaagtattaatgtaacataatttgtgcaagatctgtatgctgaacactatataatgctgatgaaagatatcaaaaaagacctaaataaatggtgggacataccatgagtatggattggaggattcaatgtaataaaggtatcaattatctctaaagtgatctatagatttaatgcaatagtaataaaagtcccagcaggttttttgttgctattgttgctgtagacaacaggaatttctaaaactctaaattataaaatttgtatgaaaggacaagaaaaataaaatagctaaaacaattttgaaaaaaaagaacaaagttgaaggactcgtactactcattttaagacttactataaaggtacagtaatgaatacagtgtgcactgacaaagaaataaacacatcaatggaaaagaatggagagttcagaaatagacccatacaaatatggacatttaatctttgaaaaaggtgtaaaagcaattcattggggaaagagtagtcttttcaacaaatagaacaagtagtcattcatacacaaaaaatcgaaaatgaaccttgactttaacctcacacttacacaaagattaattgaaaatggtggatatatataaaaatcaaacccaaatctttaaaacttttggacgacataggtaaaaacccatataacctgcatttggatgaaaaattcttagagagaaaatcaaaacacaatacctaaaaccaaaaaagtagataaataattctttgttaaaattaaaacctttttccctttcaagggcactgtcatgaaaataaaaagggaagctaaagactgagaaaaaatatttgccattcatatatccaacaaaggatttttatttagagtatatagataactatgaaaactcaacagtaaaatcatcaaattagagaatgggcaaaaggcatgaacagacatttcactgaagagggtatacagatggcaaatacatgcaggaaaggatgttcaacatcattagcctttaggtgaatgcaaattaaaagcaagataaggtaacattatgcaactattagaatgtcttaaaaatactggagtacaagagctggtgaggatgtggagcaactggaattcttttacattgccgctgggaatacaaaatggtacagccactctagaaaatagattggtagttccttgttatgttaaacatgcacttaaccatatgaccaagtcattgaattctcagtcatttttcccagagcaataaaaacatatattcagagaataacctggacataattgttaatagcagctttgttcataacagtgaaaaactggaaacaatctaaatgtccttcaaagggtgagtggttaaacagactgtggtacaaccatatattggaaaatactcagcaaaagaacatttatgccttggaggctcttaaagcctcagacaaatgcacataaatgtaaaaggtatacagataacaaaataaaggtatttgactaattcaaggaaagtcaaggtgattctactgccatgttgtggatgaggacttctagtggtggaatggaagggcttgggaaatagagaaacatgattcagggaggcagtcattggacatttattgagtgccttctgagctatgaagtgcactaacacagcaatggggactagtacgcttaagatttattatacaacaaggaaatgtgtaagtaattgcaataggaaatcaggtcccagtcatgcagggcttatagataaagtgcattcataacaagttgggtgtaaagaaaatagcctgccatacataaaatcatattttctgactgactgccattacgactggagagaggtaggatttttatttcactccagctaacataaacatcacattccaggctgcaaattgttgattcaaaaaacatgctgactttgttgctacatataaggtttaagtctctcataatctctgtcagaagcaagtcaaatggtcaatcaagccactttaaatttcaagctcttttaaagcaccgtaggatgatataccgccaagctaattctcatttaataggaatctccctgatctcaggtcacaaatatatagtggaaaaggcacacgctctggaaatatacataggatcccagtggtactgtagctccaccatcataccatttgtgtgaccttgagatttaacctctctgagcctcagtttactgtatgatggactttgtttcatggtatcatgatatataagaaatcagctatgtcactgaagaaaatggtacaagtttgcacctatgcaagtcatgcagagatttctgagattcagtaaaaacaataaagtaggcccaatttgcatattgacattttaataaccaagatttgaacatgcctcttattatcaagtaagtcttccattgctagtagtgtattaaatttaatgcttgtaaaatgcataaagaatctgcattaagggaatatgtacacaatgtttacttttaatgaactagtcagtgatacctcaaatggtttaataaacattttcatctgaacagaaaataaagagcaatgagtggaattctgaaaaaaaatgattatcaataatttgtttttcagattagttatgggatgataatgaccttaaaatgatggggtagcagcagatggttggacagcacaggcttactaagttcacattggagttagagaaatcagggagtttaaagttgggagtcatgtttcagaggacaacttgacccagaaagtaatgtcactgaagtgagcacaagtgggaattgaagaaggggaggtggaacggaagagttgaggggagggctgaggtgaaggctctaagatacagtttttctcaaacaaatgccagttgagtctcaaactggtgaaagggtggaataaaggttcacaagtggcaacattgtcatcataggccattgtggccaagggaaagaactctgtgatacacaagatgctgaagaagttaatctgtgcttcaagactccagaaagagaagggcagcactgtacttcaaaaacattttactaggactctgagcatggaaaaagtgaatagcagaaatctaggcgagacagacatataaaccgagactgatcccaatgagaatgaccgtgcccaaattccctatcgtaatgatagtatacaagaggattaacagcctgaagagagggagttaagctaaagataatggtgagaggaatcagtcatcccttgaaggcacttttctgctacactgggatttctctcccatgatttccaaaaggcatctgggagagaactcccaagtcacagactcagagatccagatagaaatctaatttgagagatcttcttgtctttagattggtgagggtctcaatttatgattgtcaatcctaattctaatgtctctgttcaacctcagtgatctcttatggcataagaatgttttgaactccacatttatttatatttatggtttatttttaattccttctgggaagggcaggccataaaattatgggagatgacagtgaaattgagtgaagctgggagaagactgcagagcccaggaggctgtaaagagaccagatatactgcatcctcactcttgcctttcttccttgctgtaacttctgtcttgacatagatagcaggaaaggggtcagatctggggcccagtctcgctgtggctttcatgtaataatccaaacctaaaagttaaggaccctcaaaaccaaagtttcccagttctaaatcacagttctcactgtgccatttccttctcaatagaattcaatgtctccccactcttacaggatcaagtaccaatttcacagcctgacattcaaggctctccttccacaaccctttccaaattatttccagccttgacacttactgcccatatttagaaacctagagtggggatttcaagcagtaagaattgtattcgctttggctgagggagtgcaataattaaggcctgaggggtaagaaactccactatcctgactctgtgtacctatccctggggtaaatgttggggagcagagcctggtgtgagaagagaagaacaggattctaaccaatattacaatcttctgttgatcagactgggacattaggacaatgatggtgccacaatgggtctgcctggttgtatgcgaggttttcctaatccaaatattaaggaagttccaacttcttactctcttgagtcaattccagcctctgtgcctttatgcgtaccaattcactcatctgtgttttccttttctttcctctcagcagttcaagcttctcctcctttaagttacagtcagaatgctctccttcagaggaagcttctctgcttgatgctgtgtcagtatcccttctctcctttcattattgtttctggagtttattaatgatcatgttaattgtatcatgttaatcatgtatgctgctatcatgaatgactgaattcaggcccttaactagatcccaagcctcttaaggcaattgttcattgccgttttattcttctcttcatccaattctagtctcaaaattttattctcccttggcatgcacaactccatttcctgtaggaggatctacttctttcattgccctttctcagtctttttctggctcctcttctactcaatcttcaattgttgggcttcttttattcactcatttgtacattaatttaatttacaattgcatttgttgtatacctactacgtgtcataacgcagtctatgcatgttgtccatgactgctttcccttcccttccctgcttttcccttccaatccccttttctcccctttgcttttctcccctcttctcccctcatctcttctctcttctctatgcttcctaaaacagactcagtattctcttttagtttcaaccaagagcttatcatttcaaaactcttacttttacgaaatattccttttcaacttcagtaccatttctagctgtactggactttctttcttggatattatagaatcatctcaagatcagtgtatcccaagccaaatagcatctacctccttcagcctggtcttctttctggatctccactttcattaactgtcaaatgttttaccaatctgacatcatcattgacttccttatgtttaacccatatgtctaattggttacaaagtgtaacttactcagccttccaaaaagttctcacgtttgtttatacccatgcttgcatatttctactgttattgccttacttctggccttcattttctctcatatgagctactacaatccccactttagtgatctttcttcccagctccccccagttgatcctccacctgcttctagagttatcttgttaagaagatttgaccatgccattcctctgctttagaaatgtttataattctccactgtatacagcacaaagtccacccaatttggcatagcacagtcagaccaacaaaatctgggcccaaatcaattttccagatgtacttcccatcattctctccatgtgtcttatacttcagctccagttaaaatacagttctttaccacataagtatgtaacataatgtgaagacccctattttaaccctgactgcactgtttcaaggtatttataagcatctttagggcaaggactatgtattattcatctttgtagctctggtgcttaccataagtagatctcaataaatattacataaactcataaaggaatgatgacctggattcatagttttatattcttacatatttttattgacacataatagatttacatactgagtttcaatttcatttctgccattccttagcaatgtgacttttgttcagttctaagccttagtttcctcatctgtaaactgggcttagcaataattgccacctagccctatagattttgaagggaattttcatgttccttttctgtcttgtcttctcaagcttctcagggccctaccctgactttggcagacagtggcaaaaggagtgagaagagggctgtggggccaagctccgagcagcagctgcagtgggcctgcctcacagctgctggccaggcttttgggaattttgcactgttaaccctttgggtctagttcttgagaaccctatggattattcagcctttaactcagcttcttgttttctgggtaacagacacagattatttacctatgcacctgcttctccctttctgagcaatccttctcatgcagacaagtaatcagacacaacattctctcccatgtctaaaattggatgacttcttaaactttccccatcttgttgactcacttgtcagtaagttctcctctttcggggaatgcagtgttccaggtatggcttgacctgcaggacaaactgttagactcaaatgtctattgttttggacattcagagtctattgctgatagctcaacttgtatagctttatttagcaactgtgtcacacccttgccttacatcaggctcagagtaagtgaaaagccccagggcattttcacaccgattgctggcatgacaaaccaacctctacatgtgcagttgatgttctaaacctttaagcaagactaagaaattgttcatttccactcatcataccagtatgctgatattctttagaatgatgattctattatgctgatattctttagaatgatgattctattatccaccttttccattcccatccatgtgttcctctcttttcatacccagctttgggtcatcagcccatttgctcatttgtccttgtcttcatcaacataatctgtatttccaaattttttattgtgggaaaatacatataatttaaaatttaccattttaaactatacagttcagtggcattatcaacattttatgttaaaaattttcaaacctatggagaagtgcaataatgcccatataccctccacctagagtcactctttataaacattttaccatgttgctttcttgctttctctcccctcacctctctctctatatatatatctatatatctatatctatatctatctatatctatatctatatctatatatctatatatatctatatatctatatctatatctatatatctatatatatctatatatatctacatatctatatatatctatatatatatctatatatctatatatatctatatatatatatctatatatatctatatctatatatctatatatagagatatatagatatatatatatagagagagagagataatatatatatattcctatttactggaggtgtgacatttaaaaatatactatggctcttgtatacaccaatggattctaggaaggagacatgaaatcacacttagcagtatccaagtgagtggagcaagggaaacaacaaaaaaaataccagtggtaagtggttagtgtttattggttatcaatctattagaaagtttttattgagtacctactatagttataagcccaacactgaaaaattatgaaatatagtccgagtctttatgaagctaatgatgtgtttggggaaggtaacaattgattttttttaacatgtcaccacctttttgtctgcttacttctagccttgccctttctggaacttcaatgcatcattcatagtatcatcaaagttatctgttgaaaactctacactcattttctttttcttttccttttttttttctttgagatggagtcttactctgtcgcacaggctggagtgcggtgtcgcattcttggctcattacaaactccgcctactgagttcaagcaatcctcccacctcagcctcccaagtagctgggagtccaggcgcacattaccacgcccgactaatttttgtacttttagtagagacggggtttcaccatgttgaccaggctggtctcgaattcctgacctcaggtgatccacccgccttggcctcccaaggtgctgggattacaggcgtgagccacagcgcctcattttcttaaccctggattcaccttaagaatgccataggacaattttaaaaagccaaaatatttgctttaacacagattggttatgtaagagtctcatgggtaggccctgaacatcatatttctgaggatccccaggtaattcttatgcatggtgagggttgacagccactgccgtggactgattaagcctctctcttttttgaaacgcttactgtcttgtcattccctatatccacacccattagcatagctacagtgacttccataaaactggcctggacttcatctcctaacactccttccataactcttcataatcttgctacacccagtgctgcttcacaactttgtaccttttcataccttgtatcttctgtatggaatatccttatcttccttatctgcctatcaaaatattatacatcctttaaaatttgaatgacatctccttcaggaagttttcctgaacttactgtttccttagcttgtaaacacttttattattatccttatcacacaaaatgaatcataaacatctgtttatgcatctctcccctactcaactgtgaagtctgagggctgggaatgtacattatttacctctgtatccccaaaacttagccaacagaactggcaaacagtaggtgcccaatacatatttgtggactaagtagattaatgaatttttaaaaaatgttttagcatctctaagacaaaaaaatgtgcaagaaggaacaaggcagattcaaaagaagaggtctgtcagttgaatactcggtgagatatctgtccttggaaagaagggattttgtctggagaaaactaggctgtgctaagaagaataactaattctatacagacaggcagccaagaacaggctgtggccaaagtgttgatggatgacagctggaagtatggcttgtgaaccaactaaaaacgacacatcaatctgagctgcaaataaatcattgggactccaaaggcttttgttcactttaaaatctcactctacatgaacatttaataagaacacttcaaattgttatagcactttactactttacactttacacattcacatacataatcccctgtaaacttcccaacacctgttacaagaacaacattatcaacccaattttaggatagaaagctgaggctctaaaaatttcattaattaacccaaggtcacacagatgataagtggtagaggcagagcatgaatagattttgagataagaaaaggagaaggaataagaaagccacaaaaaaagtgagcaaaaataaagaaaaaaatctacaatatgcacattatgtttcattctgggctttattaactacaagtttttgttgttcttttctcaataatagtaaaggggttggatcagagaagggggcactcctaggttaagagttgttcatctataatgtatgaggtatggtgcaagtcactttacatttagtatctataatagccctatacggtagatgatgttatccacactttcaacatgtagaaattgagatgcagaagatttaatcaatttgcctaaaggtctgtaagagttggaaaaaaatttgcacccgtttgactctaaaaccagtgttatttgtataacatcatatgcttaattcctgtgttgtgttagttacatgtaagaaaaatgttgtaatgaaagtattatttagaatgtctaatatatttttatgaaaataagacagaaagagaaagaaaaaaacggtgtttgaataaggttgaagtaatcatgaaagtcaacttggaagaaaagtgagacttgacttgagtcttaagagatgggtaaaatttgaagcaccaactaggcaagggagggcattctagaaagggataagaacatggagaaaggcactgaggagagtggcatctgctggaaagtcagaaaagaacccaagaactgtgggtgtgggagtttgctaccatcgaagaagtgcaaaatgtcctaaacttcactgttggagggatatattcttccccctaagattttcgggttggaggaagttacattcttggatgcgaacatcaactgagggcctttctggtacaaggaaattgaattgctgattgctgggatgtgttatgaaagggagcaagccaccagttatcatcagctccctgcggggccccactgtcgcaacagtgataactgggaaatagatcttgagataagaacaagagaagaaatcagagatgagttcagcaagcttaaaaaaaagaccccaagtaggtatcttttatagattaggttttttattgaaaaagtaatacatgcaattcatacagaaagcttcagagtacaaaaggatataaaaaagccagtctacttctgcacatacaaacatatgtacatatatgcatctttccttattaaaaaagggcattcacctgcacaccattgtgagtcttttaaaaatttcaacaaattaaattgggaaataattttatttccacacatgtggatcagttttattttttaattgacaatattatttcaatatatgaatatgcactaaattttttatcctatctcttataatagacatttgccttagtcccatttttcattaacacaaataatactgcaatggacacccttatacttgtatacatttgcatactgtgcaagtattttcataatatacatttctagaatgggaattacttagtcaaggataaatacatttttcatattaaaagatactgcaaaatcgtgccctccaaagacgttgcaccaatttataatctcatctacaagttatgaaatgcccatctctctatccccatcaatactacacattatctagcttttaatctttttcaatataatgaagggaaatgatgtttcattattgctttaacttgcattgccttaatcatcagtgaggttaagcctctttttctgtgtgtttattaacttgtatggctgtttttcagtgaaatgtccatttatagcctttactcatttttctattcatgattttgctttttttctattgatttgcaagagatttttacatattaaataacttagtccaccctgagtgagataaattgaagatgttcccctaaattgctttttgactgcatttattatattttctacatgaaaaaagttttgaaaattatatgtagctagatttatgaaatttttctttttacttcctggattttgcatcttccttagaaaaatcattttcacttcaagactacatataattattccatgctttctcttggtgtctttacaattgcattttccatttgactcctttatatttctagaacttattttggggtaaagaattgggtaatctctattctgtggtgttaatttatctactcacatactagaaccaaactgttttaatcagtatagatttataataccttttaatacgtggtgggtaaagtttctcccaacacactccttcccacctcccaccactgacttttcgttttcaaaatggtcctggctagtttcacactaaattatgtatatatatatatatataacataatacataattatatatacgatagaggacacattgataaccaaagtgatagatggctgtggtctcaagagtgagagatgctccagaacctccattctgagaggcacgcgcgcgtgcacacacacacacatacacaccacaaaacatacaaataatgtatttgaaaaatataatagtttagaggtgaagtcctgggaatacccacaatggatcaagaatagggttgccagatttagcaaataaaaatacaggatgtctagttaaatgtgaatttcagataaataattttgggggtataagtatgtctcaattattgcagggggcatgcttatgtaaagactatttgttgtttatctgaaatttatgttttactgggtgtcctctgttgtataggcaaccctaaccaaggggaaaatgaagagtagcttaaaagtacaaaggaaaattgtgtgcaatgatgaattaacacattatggtcagtgggaagcccttaatacaggcacttagacattggcttgaacagagaaattacaattctggggtgtgaattaaataagcttgttttgtcttcccagctttggtttgaaaaatgaaacctcttaaataaaatgcaagaggctcaattgatttgaaggctttttggctttctggctccagtttaaaagaaaaatcagtttaatagaaattggaaattaagattctgttttatttgtgccatactatgaagacttttgatatatagattttctttttcagattagtgtttcaagtttaaattattgggaaacttcccaaattgattttttcatttggggttggtggggaaatgtcattcttattaatcactttagataataagtcaagtagaatcccttatgatttattgtcttttatttttaagtgaccaagtgatttggatctgaaattaaagacattctctaattcatgaatatttgcttacctaattctttcctaaaaattaacttgacttttggagcaagctcctgtgcttgctcctgtggcatattaagaaaagctttggctctggagttagaaaatctggattcaagtcccagatctttgtagctccgtgctgtaaatgtgtggcaagtggctcaatgtctttgactcctagctagttcatctataaaatgggcgtagtaattcttacttcacagggttgttgtgagaattaaatgagatatacaggtaaagtgcatggcactttacaggtatttaattattatcaatttttttgtagatacttacatattgaaaagtatatatatttgcaaaatcattttcattgatgcttttctagagggtgaaattttgtgtgcatttgagttctttttaaaggctgatgagttctctatttctatgaatatgggagaatgctagataaatataatattgatataatgttggtatgctcagtatgaaacaaaagaacccaaaatatacaacatgtatcaatggggttccttatggaaatttactgaattgtaataataatgtttgcctttctgttggaaagaataagatgcaaataaagtccttttaactgcctatgggcgggataagcaccagctagtcttggaggggttgagtcttacgactattctatggtgcaccctttgaaataagcctgttcttggccacatcaattcacagatggagggtgtatggtttctgctatttttttccactggaaatttgtcaaggatttgttatatgctgcggaatggttagatgtgggaaaaaaagcccaagcaccatggctggccccaggattttgggacaggtgttgataatctgtaagagtaggaaggctgctgatgagagtgcgtgatatccaagaaacaaccagaaaaaggcaactagagacaggagtttgaatgttccatagatcatcccttgtccttttctcctttatgggctctcctcacaataattggtaggaagttagaagacctgggttctagtcattaattgtctgtgagttctggagcaagtcatttcagtttgctggacctcatttttctgatctgtccaactgagtttggggggaggagatgcctcaaatatctccaagcctggtgtgagaatcaaatgtgagaacagacttgagtgttctttgaaaaagcacgcagtgctgtatgcaaatgcaagtgtagagattattatttatcatcatttacagtgaaagcaaggataatgtgataaggacaagcaatcgttctctctggtttagatagaggagagtgggaatggccttaggaagcatccaaacctggaatttctcaggagactgagaaaacagcaaactcctccttcaacatctcttcttctcccacttttatccggtcagtttcatggcccagacccagtcaagaactcttcttctctgctagtgtttctcataagggtatagttgtctgcataccaatagctggataaacactaaagctctgttgagaggaaacgtgagggaagtttaaaaccatgaataatatggagaagatgaatattaacttttacatttaatttaaaagtaaaactctacttcacaattaaaagagaaatcttaggaggaaacttaggatccatgaaaggaaagtcgtgtcatcagtcaaatgaaaagcttggaccatcagattatttttaaaggtcccttccagctttgacattttaactgagagttcttgtgacaaaatctcagctacctttccaatacaatgtccctactactcccagcctctcggtgtaagctaatttttctgcctttccttcctagcctgtctcagttgctcttggcactaccttcaaatgcaaactctatccccttctccttcacctagataaagcctatcgagcctcctttgacactgagttaccaatgatgaaaggggtaattattgacacagcaatatgctaggtgttttatgtaatttttaaccctcacataagccttttgaaatgaactttagtcttccctgtttataggaaactgaagctcataaagtttaagtaacttgctgaagatcacacagctagtgccaaagttaggatttgaattaaaatctgtcagactccagagttgggctgtcaagttcaagactcacctcacccagccccaaagaccttcactctcctcagacaacttccaagtcttcaaaccaagccctgcatttaatgctatcatgtcgtagacttacttgatttcatatcttcttttcccaattcattttttggttcctcacgagaaaggaccatagcaaattcaactctctatactcagtggttagttctctgacttgcacacagtaggagcttaataaatatttgttgatgagtagacatcacattaatttgctgttcaaaacctgtgtttgagtattaaatatgttttaccagcggaagaaaaccatagctaaggtaatttgtgagccgaagccattgttacttctgttgctaagggaagtcagttaccctgggatactaattaactgcagctattgtggaaattaagccagcagcccccagcgagttcagagagctgatgggaggagggaatctagaaggtgtcaagtaagaaagtatattttctgatttgaagaaaagtgaccaagggagggggtagcttgtacactttcagcaccatcacacctctgtgaagcctatttctcttccttagtgggcaaagaggttgttctctataattagctcaaacagtcgaggcaaggtgaatagactgcctgtgactgagacctacacttcaggctttgctagcattgagagatacgcatctgaggggctttgacgtcaaagtagctccaaggctgaatgaaaagtaccgaagagactcttgatgctaagttaagattccagttgaaatgatgaagggaaatgaagagatcaataaagaaaggtaacagactctacctggggtgctcgttgcatttaaaagaattatctactctgctgtctaaattggagttcaacagttttaataaagggacttatttatgattctagaaaaagtctgaacagtgcacttatttatctgcaacatagccagagctcaaacttggacataagttgctctaacagactagttccacctagtgatagtgtacctaaattgcagtttgtttttctgagaaaacgaaaacatggcctttacaagtggtcactgcagcactgaagtcatgactttattcaacagctgagcaccagcttcgtgagaagccctgggctagagacactgacgcgtgtctggggaagagggagtgagtgctttgcagattggctaagcgaggcaataataaaacttctgattaacagcaggaggtgagagcaccaagcctacaggaagcatatgaaataatatttagagaccagggcaggtgggattaactctgtctctactgactcatgctgttgagagatctgtatacgaactcaaaacctcccttctgcatgacagaaggccatgaaagggtgaggaagaaaattccagggaggttctgaccagaaggacaagaggacacaataaaattcagcagcaacctggtacccttgtcttttcatgcaataattctataaggagattatccaacttcaccagagcgacactgaaatcttcttggctttagactcacatatccaaatgcctacttagttaagcaccttccactctgagcatccaaagctatgaaagcaacaggtaggccaaaatacaggtctacaagtctggcaaaccctaatcagcgctgccctgccctaggaattagtagagcaaccacacccatcaatgccagagatatggcagcaagtgctgagcctaaaatgttctggtgaatcaagccatctgtgattcagagaaaagcaagtttgatagcacatcttgtgggcaggtttcatcaagctcactggcttgcatgtggagctgttgcaccgatatttgggtaacaagaccctaaaaatactccccaaaattcacaagccttttattctattgtggatagatgcagctccacttgaggcacagatgtttacccatccactattccccacctccacatcactctcctttgccccacagtttgctgctcatgccaagactccacctccaactcatctctgggatagccaatgagcacctggggccttcgtgctgtgtcccaggttttctatcaaggaaccaagcttctagtgactacacagatttcagagtgaatcttttagattcctcctagattacaaaggttagagaatgaaggagtaaaggcttgggaatctgtatcttaatgaaatccctacagtttgttttgattcagcaaatcggcagacaagactccagactggattttgtcccagcatttccatttccacctcctctaagaagtttcccagtgttgtcagccctcattgattttctcctccttttgaattcatgtaacataaaagcaaaaattgtttgggaggctgaggtgggtggaccacctgaggtcagggattcgaggccagcctggccaacatggcgaaacctcgtctctactaaaaatacaaaaattagctgggcatggtggcgcatgcctgtaatcccagctactcaggaggctgaggcaggagaatcgcttgaacccaggaggcagaggttgcagcaagcccagcagcctgggagacagactgaaattccatctcaaaaaaaaaaaaacaaaaaacaagaattgtgtgcttttaaagggctcccaaaaaccaatcaatacaaatggttacctggagcaggaatccccttcacaaaaccccagtacatgcttatctaacacctgcctggccagccctccccactttttatagaatatagaacccaccacccaccaggcagctatttcaacccccatcacctttcttaggaacgctagtagccagaaaaatctcttccatctcactgatcccaaatcttcccatgttgcagccagaaaccacctgggggattggtaacatttaaaaaagaactgtttaaaacatttgcaaagttttctgttgtaaaagtactgtcctttgaaagtgatgctctctctttcagaaaacagttcgtagagattcttttgctaaagcagtttgtagttgctcccctgggtgtgtgtcttctattaaggcaatgatctcagaattcttgctacaaaagcccaaacaaaatgctaaatcccttcaagcatccctgaacaggcagatatattggtggtcagctgctgagggcagcttggaaactaaaatcaatctgctttagcttctgtgctttagcagtattttcttaaattgctcttcgctgttgctagttgctttaaggcaccttctgttgaagggaaaatttgtgcaagtaagccccaagaaacccctacctagtatggaaggctggaatcaaaaattcatttcaaaggaggaaataggggagaaatttgtgaatgaaaataattctcccttttaccttgcaaaagtcaccaggcagagtcttcacttaggctggtatcaaataatgattcattcatcaggattgaattgaaaactcttgagtgccagaaaggattcctgaaaaaggaaacggacggtgactgccatgtttcataactccggtgggtgccacttacaattggagggacatggagaaggctccaaaggatggttccctggtagcaaataaaacaggtggcaaagaggaggtctagcaaacatgttgaaaccagagtagggcatgaatttgctctggataataaaattaggtagcattgagggtgcgggtgtctgtttggagctccagttctgcaaggtctaggaaagcaaatccagcagaagacagaaaaacccagctcagtcccgggtactgatatattgctaaggaaggaggggatgttgataggaagttaatatagggacttggggactccataccataagaccaacttataatgaggggactagagagaaaagcaagtctggagtggagaaactgaggcagagcttgcagatgggggatttagttgtcctagctggaggagcaggaaaaggtccaggtattgagttgggagcttatgggactgatgctgcttgcatgtctcaaaatcctattgtacttctaacaaacaagcttgaaaacctggaattttcaactttttgacaatagaaagtaccaaactgactcccagaacacatagacaatataatcaaaccaattaccaaataagaaattgagaaaattgttgaagacaaattctcccctgaaagcaccaggcccaaattgtttcttggggaaggagtgggttagagaaatgttggtaaaatgatacaaaattccagttaacaggaggaattagttcaagagatctattgtacagcatgttaactatagtcaataacaagtaccagattcttgaaagtcactgggactgtagattttgagtgttctcaccacaaaataatgataagtatgtgagatagtatatacgttaattagttcaatttagtcattccacaatttatacgtatttcaaaacataatgttgtatataacaaatatgtacagtttttatttgtcaattaaaagttaattaatttaaaaggaaacataaattatgtgagtacagtgaaaggcagaaattgataaatctgtaacacatgtggaattaaaaatgtacaaaggcctaaaacagggaggaagatcccttccaatgaaagacccttggggatgtttcattaacaaactaacgtgtggtattggttattgattcaacaacagcaaaaaatattctggttttacccattcagagctcttttagttggctcccatgtccccttgacatatacccatttttttagggatttttaaaagcactttcctattttctgacactgcaagatgcttcagtctcattttatataattcctgccttggtcctagaatcagcaatttcttcaaggagtcctgattccttttactggaggatactaaaagaaaccattgacaaatcccaggtcatgcagatttccccatttgcttctaaaagttttacagttttagctcttaaatttaggtctttggttcattttgagttaatgttgttatgagattaaagttaagggtcaaacctcattcttttgcatgtgaatatttcagttttccagcactttttgttgaagacaattgttctatttccattcaatggtcttgaaacccttgtcaaatataaattgatatagatgtgagtgtttatttctgtgctctcaattctcttccattggtctatatttttgtccttaggccaataccacacccttttgattactgtaactttaagtaagttgtaaaatcaggtagtatgaatgttccaactttgttttctttctcaagattgttttggctattttgtcacccttgcaatcccatattaattttagaatcagcttctccatttctgcaaaaataaaacaaaacaataacagggcattgagattaggtttgagacggcattaaaactatattttttttaggtagtattgttaacaatatgtagtcggccaattcttgaaccaggtgtctcccatttatttaggtcttctttaatttatttcagcagtgttatgtagttttcagcaggcaagtcttgtgttttcttggttaaatttattcctaagtattttattctttttgatgctatcgtaaatgaaattgttttcttaatttcctctttgaatcattcaatactagtgtatagaaatatgctaaaatcacccaatacattgttactgttattactgggaaaaattttaagtctattaggaagtgatgactttcaagctctttaaatattggagctgaaactacaagtcttcaattctattcgattttaaaggaacagagtactttaatgctatttaatctgtttcagagcatagagaaagaagaaaagcttccaaacagataccaaaaactgacaaaactatgcccaattctcaattattaacactaatgcaaaagtaccaaattagatattagcaaatagaacccatcaactaattaaaagaaaaatacaccaagaaagtgggttttataccagaaagtcaaagagatttcaatattaggaaatccattaacacaattaaacatggaaaaaatgtataatcatttccataaacaacagtatttattttatgaaattaaatggtcatgcttgattagtaaatggaagctattactaacaagacaaaataaactgagaaagattgaaaaagaaacagaaagtgaggaaggaaaatactagcaacctgctaaatggcgagataccagaagtattactattaaagtctgaaataaggcaaggatatccactatcatctctattatttaacattatttgggggcatttcctagtacaaatagataaggatttctaaaaatgccatcaacattggaaagtagttaaaattttcatttttcatagatgatataattgtttaccttaaagcaacagaagaaatacatgtaaatcattaaaaacagtaagaaaattctcttctttttccttcctcttctcttggagttggtggtgtaatagatttagaaggtggcaaagtgaggaggcaacaggctgaggaaatggcaataggtccattagctgaggaggtcactaatgtagtcaggagattgattatatacaagagtattgaacatattagtaaatatattgagaataataggagctagctttctcgctgtcagaaagtgatttacaaatgtagggagggaaaaggctagaaagattcctggtgtttgggattttaattggagctatcgatatgtactcatgctttacacacatacacatacacactcacacacacagagaaatatagatatgtgtgcagtgtgaatgtgttgtgtactcacacacatatacaaacacatatttcctatgtctgttagaggccactaagtgaacagatcttgggttctaaatatcaccccctctaaaaggactcagggatccttgtaaaatgattgattctagaactggagcagggaaagtacatgatcctggaacatgttgttgtttttgaaagtaaggaggagatcaaagaatgatagggatgtgtgtaaagaacactggagcaggtctgaaaggtctctcactagctcctatatccaaatataggataattttagtgtcaaaataaataatgttagtaaaggataacaatcaagtgaataatataggaatccatccatgagtccatatcaaaatttcaaaatgaaagaaataaaaagaaaatgaggacgtgaaacttccttagagtagaatgttaactaatgaatgtagaaggaatgatataaagataaacatgaccacttaagaatgaccatagtagtggttgatttaggcagcgatcatcaatgaatgctaaggcaggtgagtgggtgtttgaagaacagaatagtagaatagactcagaggatcttcttacaaaatacataacaattacaaggagaaaaaatgtgactccttgttggggaaacatggcagacaccaccttgcccaggtaatgaacattatcatcatcactggtggaacagagttgccataataccccccttgatgcattactctgcttacagtatggcattattactacagtcttcttgccaggaatacatgacctgagtttggacaggagtagttaccaaataaacaagggttgagggacatcatacaaaatgaaagacatgtactctttatactgtcaagatcatgaaagtcaagaaagactgaggaaatgttccagactttaggagactaaaaatacatgaaaattaaatgtaacacgtgactctggattggatcctggaccacagaatagaaagagacatggttgggatacttggaaaaatttgaataaagtctttgggttgggtcatagtgctgtatcaatgtttatttgctgatttggatatttctatttgtgactatgaaagataatgtccttgcttttgagaagcacacagtggcatattttggggcagttgggcataatgtctgaaccttgctctcaattcaattagtttttaaaaagaatatttttaagtgagtagtggttttgtttgtttgttttttaaagagcagtagtactcattttaaaagggttgtgtgtttgtgtgtgtgtgtgtgtgtgtggagagagagggggaaaaagagagagcaaatatgctaaaatgctagcaattgtctaatatgagtaaaataatatgtgaattttttagttttttcaatttttaataaggttgcaatatttcaaaataaattatataaaaagccccaccacacaacgttgtaatttagacctaagaaaatcattgaaataaatatactgtaagtagaaaaaatgattactataaatattttcctagcacaaaaggtgattatcattttaatattaagattttaatatcattcaaaattaatccaaataagctgaatgcagtggctaatgcttgaaataccagaaactcaggaccccatctcttaaaaaatataaaaaattagttgggtgcctatagtcccagctactttactttggaggctgaggccaaaggatcactcactggagcttaagagttcaaggctgcagtgagacatgaccgtgccactgcactccagcctgggtgacagaatgaaaccttgtctccaaagaacaaaaaaaataagaaattaatcaaaatgtatagtttatttatgtaagatataggcttatatatatatttagttctttcttttttttagacaggctctcactctgtcaatcaagctggagtgcagtggtgcaatcacagctcattgcagccttgacccctcaggctcaagtgattctcccacctcagcctcccgagtagctgggaccacaggcgcataccgctacaattggctaattttttttaatttttttttgtggagatagggtcttgctatgttgcccaggctggtatacttagttctttaaaggatagcagaaattagtaagatggatgacataaagataaaaatttaaaaatgcatgtgttgctatataaatacattttttagatgtcatgaaaaaagacattacatttacagttgcaactgtaatagcaaacaccaaaaaaatgaactctaggaataaagctactgagaaatgtgcagggcccacatgaaaaatatttaaaacatcaggttgtgtcataaaactacatttaagtaaatggaaagatatacttaaaatttaattataatattaatgtgatcctattaaaacaggtaacattttaaaaaaaattaatcaagcttatttaaaaatttctctggaaaaaacctgaagaacacaaccaaggcctttctaccaaaaaaaaaataatgaaacaataatgaaatacaacatttcatgtataataaggtaaaggtaaagcaaatctcaacgacactggttcatgagatcaatgagacgaaatagagagccaaaaagaaacccaagtcatgttagaatttggtatatgaaaaagacggcacttaagtaagaaaaataatagatggctttatcaacaaatgttgctgagacaaatggattttccaatggaaaaaataaagttggctcccaatctcactccatacgccaaaataaatttgaagtggatcaaaggtgtgagttaaaaatgaaaacaaagtactagaagccaacatggggtatcttgtcttcaattccagagtggagaactttctaagtatgatacaaacccagaagccataaaagacaagacagataaattaattattcaaatatgtatgaacttcttctggaaaaatggaatgtatgtattgtttcctatttctcctgcaaagtacagataaaatccctggagattatatatgaaacaaccacaagaagacagaaaggtgaaaagaaaaaggcagacaagatagagacctcaggaccaaggaatggcattgtggtgagttccttgagtattctttttgcttcttatttccaatccaggtaacaaagacactgtaaatataaaatcatcaaaggccactaccaaagaaagaagtggtaagaaaagcctattctctctagctaaaaaagaaaacttttagacaataagcactctctgaccacaaaccacagaaaatgtttgacccattcccactcctggagcaaagaccaaatgaagaacttagacttgcaccttccccgcactaaaacaaggtgccctgacatccttgtcagggtgatgtcataggccagtgggaagtagagacttccaccactgttggcaataatgagacataatgataatattggccacatagggagtagtaatgaggatctcttctacatactaccctatgccaataaagaccaaatgaaaacctgaacttccaccctaacctagcagatgtcagaggaagtcagttaaaacgtaaaatttaaataaaatcaagaatatcataacaactgaaatatccagatttcaacaaaaaattataccaagaactagaaaaatctcaacttgcaaaaagtaagacaatcaaatcaacagataccaatccaatgtcgacagatatataattatcttatagggacttatcatcatacattataataatgtttcaacacaaaattacaaacacacgaaacaaataaaaaagtagaaagtctcatcaaaggaatagaaattctcagcaaaaattaaagatataagaaacagctcatggatatattagaaatgaacaatacaatagctgattttaagagttaatgggctcagcagcagaatagacaggactgaggaagaaatcattaaacttgaatatagaacaatagaaattaatcactttgaataacaggggaaaaatgaaaagagtccagggacatacggcactataaaaaaaataactagcattctggtcattagaatctcagaagagtggggaaaactttaaaagtttgaagttttaggtaaaaaggaaaaagactgaatatataatggccaagaatttcccaaatttgggcccaatgtagtggctgatacctgtaattccagcacattgggagactttgcaggaggatcaattgaggcctggagtttgagatgagcctgatcaacatagtgagaccccatccctttctgtaaattatataatatataataaaaattttaaaagaatttcccaaatgtggcagaagacacaaaccaacagattcaagaagttgagcacacccgaaacaagataaattcaaaggtgcacatcataattaaacttcaggaaactaaagtcaaagaaaaaaattaaaaagccactagagaaaaatgacaccttatctagaggggaataccaattagaactaaagggagttcctcattagaaactactgaaggtgcaagaaagtggcacaatatttttcaagtgctgaaagaaaagaactgtcagctcaataatctatatatagtaaaaacatccttcaagaaagaaagagaaatcaataccttctcaaataaagaaaacctaagagatttttttttttttaccagacctaccctaaagaatggctaaagaagttctctaaaaagaatagaaatgatttttttaaatcttggactatcaggaaggaagaaagaataaaaagagggaatatacggataaatataattgaacactctcaaatgtgtttgtggtgtagaaaacatttaaaacaattatatattatatggaggaggatcaaaatatgtgaacagaggtaaattttctatacatcacttgaacaggtaaaatactggcacaagtataattacgtaagttatgtatatataatgtaataactaatgcaactagtgaggaagttatacaaagagatacactcagaaacactatagatactacacttgatcttagccaaaaggccaagaagggataaaaatactacagataaataaaaattgaattctaaaaaaagagtaaaaagttaaataaacacaaaggaagacagtaaaaagaaaatagagaaacaaaacacagagagaacagaaaaccaacagtaaaatagcgtaattaagccctaacatagcaataattacattcaacataaattgtataaatacactaattaaaagagatttgctagtggatttttattttattttattatattttattttattttattttattttattcagatggagtctcactctgtcacccaggctggagtgtggtggcctgatctcagctcactgcaacctctgcctcctgggttcaagtgattctgctgcctcatcctcctgagcagctgggattacaaatacatgccaccacatctggctaatttttttttttttttgtatttttagtagagatggggtttcaccatgttggccaggctgctctcgaactcctagccttgagttatccaccttcctcagcctcccaaagtactagcgtgtttttttaaatcctcaattacatgctgtttaaaagacactcacttctcctgtagtagtataggtaggttgcaagcaaaaggacagaaaatattaagccatgcaaagattaatcaaaagaaatcaggagaagctatgttaatatagcctcagagcaaagaaaattaccagtgacagagacggacattgcataatgataaaactgtcaattcacaagaaaaatgtaacaatattacatctatatacaccaaataacagagatacaaaatgtgtgcagcaaaaactatagaatagaaaggagaaatagtcaagtccacaattgtatctggacatttcttttttttttaatgttttttatttattattgttatactttaagttttagggtacatgtgcacaatgtgcaggttagttacatacgtatacatgtgccatgctggtgcgctgcacccactaactcgtcatctagcattaggtatatctcccaatgctatccctcccccctccccccaccccacaacagtccccacagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtatatatgtgccacattttcttaatccagtccatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactaggttacagtcccaccaacagtgtaaaagtgttcctacttctccacatcctctccagcacctgttgtttcctgacttattaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccgtgcctatgtcctgaatggtagtgcctaggttttcttctagggtgtttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttctctcaggtttgtcaaagaccagatggttgtagatgtatggtattatttctgagggctctgttctgttccatcgatctatatctctgttttggtaccagtaccatgctgttttggttactgtaggcttgtagtatagtttgaagtcaggtagcgtgatgcctccagctttgttcttttggctgaggattgacttggcgatgcgggatcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatattcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttggactgagacaatggggttttctagatatacaatcatgtcgtctgcaaacagggacaatttgacttcctcttttcctaattgaataccctttatttccttctcctgcctaattgccctggccagaacttccaacactatgttgaataggactgtggagagagggcatccctgtcttgtgccagtttgcaaagggaatgcttccagtttttgcccattcagtatgatattggctgtgggtttgtcatagatagctctcattattttgaaatatgtcccatcaatacccaatttattgagagtttttagcatgaagcgttgttgaattttgtcaaaggccttttctgcatctattgagataatcatgtggtttttgtctttggttctgtttatatgctggattacatttattgatttgcgtatattgaaccagccttgcatcccagggatgaagcccacttgaccatggtggataagctttttgatgggctgctggatttggtttgccagtattttattgaggatttttgcatcaatgttcatcaaggatattggtctaaaattctcttttttggttatgtctctgcccggctttggtatcaggatgatgctggcctcagaaaatgagttagggaggattccctctttttctattgattggaatagtttcagaaggaatggtaccagttcctccttgcacctctgatagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgtgtagaggtgtttgtagtattctctgatggtagtttgtatttctgtgggatcagtggtgatatcccctttatcattttttattgcgtctatttgattcttctctctttttttctttattagtcttgctaacagtctatcaatttgttgatcctttcaaaaaaccagctcctggtttcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaagatctttatttctgccttcatttcattatgtacccagtagtcaatcaggagtaggttattcagtttccacgtagttgagcagttttgagtgagattcttaatcctgagttctagtttgattgcactgtggtctgagagacagtttgttataatttctgctcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtctcattgatctgtctaatgttgacagtggggtgttaaagtctcccattaataatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttttctcttttgatctttgttggttgaaagtctgttttatcagagactaggattgcaacccctgcctttttttgttttccatttgcttggtagatcttcctccatccttttattttgagcctatgtgtgtctctgcatgtgagatgggtttcctgaatacagcgcactgatgggtcttgactctttatccaatttgccagtctgtgtcttttaattggagcatttagtccatttacatttaaagttaatattgttatgtgtgaatttgatcctgtcatgatgatgttagctggttattttgcttgttagttgatgcagtttcttcctagtctcgatggtctttacattttggcatgattttgccgcggctggtaccagttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccaagagatccgctgttagtctgatgggcttccctttgagggtaacccaacctttctctctggctgcccttaacattttttccttcatttcaactttggtgaatctgacaattatgtgtcttggagttgctcttctcgaggagtatctttgtggcgttctctgtaattcctgaatctgaacgttggcctgccttgctagattggggaagttctcctggttaatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccatcgctgataccctttcttccagttgattgcattggctcctgaggcttctgcattcttcacgtagttctcgagccttggctttcagctccatcagctcctttaagcacttctctgtattggttattctagttatacattcttctaaatttttttcaaagttttcagcttctttgcctttggtttgaatgtcctcccatagctcggagtaatttgatcgtccaaagccttcttctctcagctcgtcaaagtcattctctgtccagctttgttccgttgctggtgaggaactgcgttcctttggaggaggagtgttgctctgctttttagagtttccagtttttctagagtttctgttttttccccatctttgtggttttatctacttctggtctttgatgatagtgatgtacagatgggcttttggtgtggatgtcctttctgtttgttggttttccttctaacagacaggacgctcagctgcaggtctgttggagtacccggccttgtgaggtgtcagtctgccgctgctggggggtgcctcccagttaggctgctcgggggtcaggggtcagggaaccacttgaggaggcagtctgcccgttctcagatctccggctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcccagctgctttgtttacctaatcaagcctgggcaatgtcgggcgcccctcccccagcctcgctgccgccttgcagtttgatctcagactgctgtgctagcaatcagcgagactccgtgagcgtaggaccctccgagccaggtgcaggatataatcttgtggtgcgctgttttttaagccggtcggaaaagcgcagtattcaggtgggagtgacccgattttccaggtgcgtccgtcacccctttctttgactcggaaagggaactccctgacccgttgcgcttcccgagtgaggcaatgccttgcccggcttcggctcgcgcacggtgcgtgcacccactgacctgcgcccactgtctggcactccctagtgagatgcacccggtacctcagatggaaatgcagaaatcacccgtcttctgcgttgctcacgctgggagctgtagaccagagctgttcctattcagccatcttggctcctccccctgtatctggagatttcaacacctgtgccagtaattgatagagcgagcaggcagaaaatcagtaaaaatatagatgatctgaatggtactatcaattttatctaattgatatattttttttgtttttgtaagtttttattttgaaataagtttagattcacaaaatcttaccaaaatattccagagttcttgaatgcccttaacccagcctcttccaaagataacaacttacataagcatagttcgttaccaaatacaggaaagtgaagttgttacaatactgttaactacagaatttatttggaaatcaccagttttaacatgcatgcatttttgtttgttttttatatgtagctttaagaaatcttaacacatatattgattcatgtcaccaccaccgtaatcgagattcagaatgttgcatcaatgcaaactccctcatgctactttttcatagtcacaacctctcctcagccctaacccttggcaatcagaaatcttttcatctttagttttgtcattagtagcatgttataaaaatggaatcatacagcatgtacccttttggtattggctatttcaactaaagcaaattaacctgaaatccatccaagttgttctgcgtatcattgttctgtttttattggccactaataatctatgatacgaatatgccactatttgtttattcacccactgaaggacatctaattgatatttatagagtattccacctaacaacagcagaatacacattcttttcaagcactcatggaacattcaccaagatagaccatctcctggaccataaaacaaatattgacaaatttttaaaaattgaaatcatacagtatatgctctcttaccacaatggaacatagaaaaaataacagcaaattttcaaaacacattggaaactaaacaacatctttctaagtaattcatcagccaaaagaaagcctcgagggaagtaaataaatgcactgaagtaaatgaaatgaaaatacaatgtatcaaaatttttgggatgcagctaatgcagtgataagcaggaaatttacagcagtaattttttattttagccaagaggaaatagtctccaatcaataacttaaactcccacctcaagaaacaagaaaaagaagagcaaaataaatccaaagcaagcataaggatggaaataataaaggtaagagcagaagtcaatagggttgacaagagaaaaacaatacagaaaatcaataaacaaaaatttattcttcgaaaactttgaaaactcttcatagaaaaagaaactctactgtaatcaatgttgaaaatataaaactttggtggggggggaatatctgcaacacctattacaaagactaagtttcttaacatatggaaagttcctagcagtcaataagaaaaatgaccaacagcctattcaaaaaatgggcaaaagaaaatgagcaacagttcacagaacactgaacatgtctttacatactccaaatgttaagattaagaggtttgataatatattaatttatgataatataataaaaatatgagaaaataacctcatatattgttgatggagctgtaaactctctgaaatcacattttatttggtccagcaactccagtttgatgaatttacactacagatatacctacacatattttaaaatacttatacaaaaggatatttattgtacattgttgcagtagcaaaagatggactataacctaaatgtccatcaataggagactgattcaattattgtgcatttatgctatgaaatatcatgcagtcattaaacaaaaaatatttgatgtggtggattgaaaacatgttcacaaatccttgccactccaatcaagatgtggagtctgactgtttactaccattttaaaatgttttcttacatgaatgtggtatttaaacacaatttggaattttaccttgtataacttaagaagcagagagagtttgtttagggggtagatcttccttctatgaagcaaatgttccattatttccttctggttagaagtatcagtcccagagaatgattctatggctcctaaaataacactacttataatgacacctagtcagagctagattgactgattattttcttagataacagcctttttgagaaagatcacatatttacatcaaacctggctgtttacattgtacaagttaaaggtttttagtatattaacagagttgtgcaaccattaccacaatcaattttaagatatttttaacatccttccccaaatcttacatcctttagcagtcactcctaatctcttcttccctagcccatggcaaccactaatacaccttctctctctatggatttacctattctgaacatttcgtataagtggattcatacaatgtgtggtcttttgtgtctggcttcttttacttagcataatgatttcaggtttattcatgttgtagcacgtagcagtacttcattttttattgccaaataatattccattttatggatatgccatattttggttatccattcatcagttgatggacatttgagtcatttttgccttttaattactacaaataatgctgctatgagcatttatgtacacgtttatgtgtatatctatgtattgaattattttagatatatgcctaggaggagaattgctggtccacatggaaattctgttgaaccttttgagggacagtcaggctattttctgaagtggttgaaccattttacattctcaccagtaatgtgtgagagttctgtttcctccaactccttgccagcacttgttattatatgtctgattataaccatcctagtgagtgtgaagtaatatacctcatatacctttatatattttggatatttataagagcctgatcagacatatgatattcaagttttttctcccattctgtgagtttttttttttcattttctgttttgtagcaaattatatagtttgctttttaaggaaatctaattatttatttgataattgtgcatataaaagttagaagtgagaacataacgagttaggagtgcagcctctgaattcatatatatctggacgtccaaacttaacagactttttcctgcttaaaatcatgaaagtaattttgtttaggtagccattctggcatgtttgtccaaccatactcttaagggaaaccttaaatattaatccagtcatagtgactcaattcacattgccattgattgctaacagtgatgatgtgacaattctttttcctttaatagatttattgagataaaattcacatgccataaaattcacccatttaacgtatacagccatttaacatatagattttacctatttaacgtaacacccatttaacgtatagatttttaatgtatttacagaactgtgcaaccatcaccacaatttagttttagaacattttcaccatcccaaagggaagccctgtacccataatcagtcacttccaattctctccctgccctagcccctggcaggcactaatctactttctgtctttatagatttacctattctggacatttcacataagtatagagttatacaatatgcagccttttctatatggctttttccatttggtatggtgttttcagggttcatctatgttgcaggatgtatcagtacttcattcctagatatggtttggatttgtgtcctcgcccaaatctcatgttgaattataatctccattgttggaggaggggcctggtgggatgtaattggattatgagggtggatttcctccttgctgttcttgtgatagtgagtgagttctcatgagatctggttgtttaatggtgtgtagcacctcccccttggcactctcttcctcctgcttctgccatgtaggacatgcctgcttccccttcactttccaccacgattgtaagtttcctgaggccgccccagccatgtttcctgtacagcctgcagaactgtgactcaattaaacatcttttctttataaattacccagtctcaggtagttctttatagcaatgcaagaatggactcatacatgcggcatgtatcagtacgtcattccttttcatgattgaataatattccattgtatggatgtaccacagtgtgtttatccattcatccattgatggacatggataaacatgttgggttcttttcaactttgggctattttaaataatgtttctgtgaaaattattgtacaattttttgtgtggacatatatttccattttttctttgctagatacaccagaaaggaaatgctaggtcacattttaaccatgttaaattataatcaacatgtaaccttttgagggactgtctgttttatacagtggatataccgttttgcatttccacaatgggaaattgaactttccagtttctccacattcttgctaataagctgattctttttttttttttttttttagatggactctcgctccttcacccaggctggagtgcagtggcgtgatcttggctcactgcgggctctgccccccagggttcacgccattctcctgcatcagcaccccgcgtagcttggactacaggtgcccgccacctcgcctggctaattttttgtatttttagtagagacggggttttaccttgttagacaggatggtctcgatctcctgacctcgtgatccacccgcctcagcctcccaaagtgctgggattacaggcatgagccactgcgcccggccaataagctgattcttaatggagatgacaggaacctagaaaccaaagaggatcatgagaaagagaagtagtcagggaatcaggtcagagacaaggaaacaaacaaaggattggaaggctcatggattcatagcaaccaaaacttcaagtagtttagatattatgcctgcctagattcagagcccctgctcttcccactgtattatatttctctatgagaaatttttaaaatggaaatgagggaaaagtgagttagaggaagaggataggaaagcacttaatgagattgaaagctaccaaaattatcctttctctgttgaagcagaaataacaaagtcccaacttcaggcactgaacaatggaagtcatatctgatccttgaagaggatggctcttcctttaccctgaattgaatctatgttcatctgccaccactgtgccatttatcacttccaatcacattcaaagaagtagcgatatctcattcccaaggttctgcatccccctgtttagcctttcccacccacatgggctctgcggttttgaagatgtcttgttggtttttctgcagcctgggaccaggacaccacacgctcaatggatgttgtaaggaattacaggtgatgtttgtgtcttgtgagtatggatgtggagatcatacccttcagttaagaataattctaattctactatccactagtctttttcataaaatggagttgcaaagcctcccaaagctgtctcctgttagtggtcattatccttattgcattctgttttttccactatttaaatgaagacatactgcccggcatctcccccaggcacaagttctactagtaatgacaattttttcattaataccaattgtatacataatcttattgagtttccacaataacctagagagaaagaaactgtgattacctttaggttttatatgaggaaactgagactatcgtgcctttggattgatcagaggctgaatttaaagataagtgaacattgttggacaaacaaaagacctcccagctctcaaaacaatatctactggaggtaggtggaagagaaggtgggtagaattagggttttcaatgtggacaataatcaagtacaaaggagacagttatctatccagatggtttagactaatgattcccaacatgcttcatgttgtgacatgctaattttgtctaattttattaattccctgaagcaatatgtgggttcttaaaagtaattaaagtagaattaaatgttatgttaattaaacatggctttaaatgaatttgagatgatgtgaattggttttgccccttgggataactgcaaagtgcctatcctgattttgtgacaactcagagtattaggaactgaaatcttcagaaacttgaaagaggtgactgagccagaatatctatcaggtccctgagtttgcatcttagaagttttgtcctagttgtcatttggtacctgtgggaggtaattccagtgttatggtaaagttcattctagagatgaataatcctcctcagatttacctttctttttatctttttcttttgggctgctccttctccttcatgctatcactatagtaaggcaactggaccgccatgctttttggattcactccccatttacctctctgtcctgcttagatttctcccactttcggttcccatggccagggtcctgtctaacctattttccaagcatcaaaagtgtctttacaaatctgttctgcaactcccactactgatgacttctgtgatattcctcctttggtcaagttggtcttctttcctcctcctctgtgacttggaagcctttagttcccactataccatatccataaggattcattattcttaacattgtcagttggccctctgctccagatcatgcacatgtccttctacccctcacctcccacctgactgctctcagcctgtgctatagactcagggtgtttgcctgattccccttgacccccatccttggggtagacacttactgggctgagataggctggtttcagtgcccgtgccaaggtagtctgcatgttccactgcataatctgaggacaaatgtctggtaaaatctttcagaattccagtcatttctcctgtccgcctgttcaaactgaagtttcatttaaagcctttgtgtttacgagaggtttgatcatagaaggcaaatcttcccagtaatgtcatttagcctatgtttttatttctgcatttaataaaatgcagtcaaattccaaattgtgtatttcactcttgcttgagcatattgatagaagctgttgtcagctatgtgttcttcctatcaatcagtcttttcaaagttctttgttaacaattagtcatcagggttcatccatacattgttgtattacacaatcaatcattaaactcaaggggaaaaatgcttattgatgtgcatatttttcccgatatattttaagtgaaaagagcagggtaaaaaaccgtattacattattattctattacaaacacatttacacacacacacacacacacacaccccccatgaatatattttaaatggaagattaaaaggacaccaaagtgctaacagtgattgtctctaggtgccaagattgatcaatttatatgttccccttccttctccatattttccaatttctcaataatgagtgtgtaattcttttatagtcaggaaaaagtaattttagataattcaattagttatcaaggtcaaccagcatgtgtggaaaaggtgacaattcttactgaagagaaattaacacctttattgttatgaattgaggttactttttaaagtaggaacctatctctaaaattaaaatggaagtggaaacttactgagtttgaaagaatcattttacatatcacttttcaagtaaaaccaatttctattttgctttttcttcaagtgcttaaacattttctcttctggggcccttattttatgctccccaagagaaagggccatgtctcctatttcctttggcatctcccaccccctccccactctctttcctgtactgctatacacccaagaataagtcagtgcacacgatgtgcacgcagaaaatgtttgttaatggacttggttatttccgttttctactaaatctcatcctagtcatgttttcagaatcatagaacatggctccttactcctcagaagcctggtatctctccctactgctcttgcttagtgccctgggtcccagaactccacccttagatcttcactcttgcagtgtgaggtagaccccagccagttccgagctccagggcccttgcaaggatgccaggtttacgccagccattttccctgactcatgggggcttggccagcaggtcagtcactacccaggaggccagtcactacccagtctcgaacattcctccctgaatcagatgctgctgactggatacctccaagaatcccagtgggttgacagaagtgtcagctttaggccaaaggagtctctgggatgtccttgccttggacagaagctggggaccacacagccagctgactctgctgccctgcctttggggttatagcatcttgccactgggccccccaaactatcctttccctcaatacctgctcatttgctcaggtccccggatccagcctagggactgtctcggcagggtccttctatcagagagcccaggaccagatgctgctctgagcaccaccacccagagcagcaccagggagggatgcccagcccagaatagctggagcagcccccctgcccccaccccctgccgaccagggaagctgactgagctcaccctgagtgtgctggggggcagaggagaccatgcagatgtgctgagagctccctggaaagcaaggctcagcttcttctgctactgtcaccagcagatggagagaggggtcagtatttatcctcttgtaacacctgaggggacagagttgctgacatgtctcatagagtccttgtcccccacctccctcacccattgcccacactccctcatcctctcacttcaagaggccttgttacccccctaaaggcctggattaggctccactggttaaaaatcttgttctaactccaagtcccctagaatgtccatacctttaagggctggcactggtgcagcaggactgaggtagagaccccagagattcacttacatagctgtttccagtagccaaatgaccagggaccactatttatgagacaataggatatccctttcctgagaacatgttggccaagcagcagaagtgggtgtgttgtccctgaggctgaatttggtggtcttgagacctagcatagtgaggccaaacactgacttggatgggtgctgagcctgtgaaggaaaaaactctaccagagaaacctgactgggttcgctttgtttgtacagatctagtggagttccccttaagcctgagaggccactggagcctgagaggccactggagaccaagtctggttatacgctgtagaagctgggtaaataccatttggagcacaggtctgcagcagatccagagtaaataaaacctgatacctgcattggacatctaaaaaatgttgaatctggcaagctataaatgataacatgaaacagttattgagtgtgtgcgatgtctggatactattctaaccaatgtgaatgcatcatcgcatttaaacctcgcagcaaatttaagaagtgagtaatgttattattcttatcttacaaataagaaaactgagagataaaaaggttaagtaacttgtctaacatcacagaatttggaagtaagagaaatgggtttcaaagtctggcagtctgattctagagcttgtactcctaaccactacattatactgcctgacaaagataaaagaaacccctctctgtgagcagggctggcttcatgagcatgtgattgtacaagaccttgagcttaggagtgctctgcacttaaagtttaatgtcactgtcttgaaattttaaataatttgaatattagcataagtgaaatgcaaaatccaatgggacaatcgagtattcactgggagtttggaatatctgataacacacagtcccacttttcaccacctctccacttccctggggtaggtttttagctgtcactcgcttctttcttagtactcaggaccccatccagcctccccttctctatcctgcccagtaatagctacaaccctccacacaagggaactgagccagggcacaaggagaattggggtcatacacactctgcaaaatctcacagttggacatgataacagcaatctggccccaagtgagcagtgtcatggtgcatttggcaggttatccagcagagcctattgcccactccaatccagacacctagtgcatactgtgcagaagttgtaatactcttggtggttgcctgaccacagtgggttggggcagcctgcccatgggaacgggatatacctggtttcacttcctccatgctgaacagagcatgatgcacctatctgtgcagaagctgatataaggaaaaatccagtaacaagtgagtcatgcacatgggcagcgagtcactgggcagaatcactgcccacttatgaagttctgcacttgctccacaaatatccctgtgcctgtgcaggtgtggcattaaataacaaaaacagcatggcaggttgagagagagactgcagaagagagaaaaacaaagctttatatctgagcacctttaatagcacttcttcctgtttttttcaacatggagcttcacatttacattttgcattgggcctacaaattatgtagctagtcctgcctacaaggacactctattactaaagaattttgctatcctctgagatctaccatttcccatatagaaatggtgaaggctgatgaggctgtagttgtctctggtatttctagggctgtttggagggtgggggacacttcaactagccaaagagatagatgctaagtcagtgtctgcaattcagtctgataaggcccattttgttcacccttccagcttgttaagcatcacacaacatgaaagggctgtagtagacagtattctaaggtcgtgaatcaggaaatctgaatgctaattctgcctctgccactgactagctgagtgatctccagaatggtgcctttccttggggatgctgttttctcatttgtgaaaaaaagcagatttgattactctagtgttttcaaactgttcttgagtttctgtagaggtgcctcagggatggagaagtgagtactaggctatgggtgccccatactttcttcagccaaacatcttccactttcatgttttgtaaatttttgttctgtatttaaaattatttttaaaaaatcattccaatgcttaaaaaattaaaatccatcagtctaaattctcactatgggccctttcacctctgacttcagattctgagagtttctaatcatgaacctcacaaaggaaacaaatgcacttttattccaggaaaaaaatcttccatgtccttgagccagttaccagagaagagcagaaatccagggaggacaagggattgacctgggtagtattgagctggaaggtaaaagcaatgaacaaaaagaggttcagattccttattttggagcgacagtgtcaacaagaaacatctgccaaaccacaaggaccatgtagaagctggtgtcccaggaggtaagattttctacctttcctccattgcacaacaagctataaccatgcctggtggagaaaatggatgaataaggaaggttagctgtgagtgaatttcaattctgctaatgttttttgaaccattaccagataaccaggccctgtgtgggacctaggtgggagccaaaaaaaaaaaaaaaaatggctctatccacttaaagggtttcaatctaggcagacaaaacagaatatcagaaaattgcacaaagaatttcataagaagggcaagcgtcataatgctacaaaaggcatgcaaagtgcaatgggagaacagaatatgcacactcagtttcctctgaaatgtcaggaaaagctacctagaaacgaagataggatttaaatttggatttagtaaatgaatagaacttggacaaacagggcatggagagatttacatatcatatttacgagtttcaaatttatcttataggcaaagagagacgtggaaattttaagcaatttggagggtagaagaaggctgatgtggtcggatttacatttaaacctctgtggttgttgtgtgaaagtagatttcacaaaatccgggatggattcagggagaagggttaaaggaccatttagctaatcctggcaaaaaaaaaaaaaaaaaaaaaaaaaaaagagtgtgccagtgatggtggaggcatttgtgagggagaattgacaggatttggtgattgactgaatgtagcgagtggagggaaaggaagtgttaagggttgactcaagtttagggctcaaaaaactggatggtgccattcacataggtaggggacaaggaaagaagagcatcaggtttagaagggttcaatttttgagataataaatttgaagtgcctgagaagctaccaattgcaggttccaactggtagttggatataaggatctgaagctctaagggaactgggtttcacatggctaccaagtaaaccgcactgccacactcaaaactagggtttagggttttttggaagatggctactagggctatatagtttctgggagtagtagaggcagaagaaaaactattcttagaactcaaagatccctagattatagattaggcactaacctagatatagataaatgctactttctgcttttccttgcagcttgaccaatttgattatttctctccaactagttgtttgattttggtcaccttctcttctttaggcattagttttctcatttataaaagagcttaaggttttgtattattcatatataagattgtaagcttataaaaatatcttgttgttcaatatatttacacaaaatagcaatatccaggaatttcatgcaaccttacaaattctgagaatgagttagccatggactaatgaattaattggggttttatttacacttgcattgtatgttagaagtatattcaagaatagcaatggacttggccctggtccactcagaatttgcatatagaaaaattatagctgcaattccggcctggagttcctactaaccaatgattcattgttctttacaaaggatttgcaaactctaattagtgagcccaatctattatttagctatcaccctatttaagattcacccctacaaatctcaataattgcacatgagaattcatgtatatgcttacatttttaagtctcacagtgcagtggtggtagagcatttggaatagaaacatttagaagtgtcctgaatctttatgacagacacgtactgaacttaattcagtctttggagcactaagtaaatcctcaatataaggacatgcatggtacagcaaagttatttgcatcccagttgtcatccatgttctcttctataacttacagtcaaattatatagtttcctaaccttgttatcttggaattattttaactcatgactagggttatcacacaggcttaccactcaaactgacatatttatactcacatacatatttccctcctaaatatttcttatcagacaattgtttcataaaatatatattattttgtttatataatttctgcctacggtgttgctgttgatctagacaactacttttaaacaattagttagagtaattcagtttttcttaagaagacttcatttgcaggcaagaaaaacactgtgaataaaaccgtgagcaagtcttcacagaatattttgcatttttgagacactcaatagaagattaaggactatgtctcaatgtttttcatagggcaactttcacttcctcatttctcaaactatagatgagaggatttaacatggggatcaccattgtataaaatactgacacaatctgatttcctgccccggatccatgtcgcgaggcgggcaagtaagtgtacatagttgtttcatagtacaggctaacagcagtcaagtgggaggcacaggtggagaaggctctctgttttccagaagctaagggaattcctaggatagtcatgagggaagacatgtaggagacaaggatcaccacaacagaggtgaccagggtgaatcccccacagccaaccaccaagatcgggaggtgatccaaggatctgagcaaaccagtaccaacaatgagggaatgtcacagaagaaggcagggaggacacatggttgacaaagcgatagttgtgtgatggaagttgtcacagtgaccatcttaactaacccaccaaggtagcatcctgctaccaagaaaagataatggcctcttgacatggtaatgtggtagaacagtgggtgacagatggcagtaaagcggtcataggccatgcaagtttaaaaaattgcattcagcagaggcaaagattacaaacaagctcatttaagttatacgggaaaaggaaagaaacatactgcagcttagaaaacaaatgtgctaaattctgtggaattgtaatggaagagaaacagacatcaaggaaggactgattagagaggaaaaagtacatggggtgtggaggcgggagctgactctgatcagaaccacaaggcctagattctccaacacagtgatgatgtaagcaataagaaagactccaaatagcaggacttcaagctgagagttatctgtcatgccgagaaagatgaagtcagtcaccatgggtgaattttccactggcacaagctgagaattatccttaagtagttaaaagttctttagacactctttaagcgagaaaataagagaaaactggatgatatggataaaatgataccacacaaaacacacaaatccacaaaattctccaaccctgcctctcatctacattcttactttaaataacttctcaaatattatcaccattttccaggtataacattgaaaatgtaaatgctgaaggaaaaggggagggtggggaaagaaggtaaaaaaaaattcagaaataaaaggaacaaagggaaaaaagtaaaagtctagtctgcaaaaggtgtttgataatatttattgaaggaatgaataagtgagggagaaagaaaatgggtgtcgtcaagagatgctctttactgaaacaggactacaaactcttagaaaaaaaacaatccatgctatggaattatatatcactctctctcccttttccaaatcatgcccaaggaattattgaaaatgaggtaacaatagggcaaaaatgttaactcattccatcttcacagatagttccccccctttgagtatttgtgacattatttctgagacagcagaagtcaatactcactattctgcttgaccagtagagtgctttccaagatcttgatcatcatttcactggtagattattgcagaaaccctcatgctcctaaacgaccataagaaactgagctcaaatttgaaggcatcacttgtatcctgtgaaagagaaaccaaagaatgaccaaacccctcagaaattatgtagctcctggctgatcgtcacctgctgattcctctaaccatgcttggggcaaaggtaatgcagctgtaaaactgactgtgaattctacaaggacttattgagcagacatgtctgagcaaaggaccagattgcacaatggttggcatcaggtgccactggggctaagtgcatggtcactgttcctctcttctatagtgatagattatctctgatgctggcttgctgcctcgaacaaatgccctgagtgaagtgccagataagagaagggatgagtccacctccatttataaaatctaaactaactccgagcccctatggctcactggacagccatcggtaagtggtgtctagaagggattgctgtatttggctataggtagacgaggggacatttgagtctctgaccattggttaaaagggcaatcttggaaacaacagacactggggactccaaatgtggaaaggaaaggattggagcaaaggttgaaaaactacctattgcatacgaggttcactaactacatgatggattcaactgaagcccaaacctcagtgttacgcaatatacccatataacaaatctgcatatgtacccccaaatctaaaataataaaaaaagaaaagaaagccattgctgtttccattcaccataagacacaggttctttacttggcagtaaaataaccaattctggagctataagaatctctttgaatcctggatcgggagatcactggctctgtaacctaggacttaacctatctaaacttgaatttacaaatctgtaagggaggggcactagtagaacgtatgtcactggacaattgtgaagattgaataaagtattgtaagtaaagcacttggcacatgttagatgctcactgattcctactttctccattccttcatgaccactcccatttactactttttttctccctattttaccaaatggaagcagaggtattatgtgtccacattattattattttagatggacagaagtgaacctttgacagactagctgaagtatactgaagtataatttccatactccactccctattacacacacgcgcgcgcgcgcacacacacacacacacacacacacacacagagagagagagagagagagactttgctcagaatggatgaaagaagggtctttcacttgtgatggtaattcactcatttttgctctacccaaactgtgagtgttaacttccgctgccgctgcagctgctcctgctgctactcaacacagcaccccacccaggggaacattcagcaacttacacgattaaatggaaagactcagggagaaaatttggggctgaatgaaggttatggaaagagaactgttttcagagacaaagacatgagttctagtcctggcactaattaatttgtattgtcattcagctatagaaaagccacttaacctctttgagccccatattttctcatctagaaaatggtaaaaaaaaaaaatacctactatgcctctcttttagggttggcatgataagataatgaatgtgaaagcactctgtaaactctgaagggtgatacaatacacatggaatggatccctattattattccatcatggaaggtgggagagggaggaggaagatggcaagatgataattttctgttgcctcctccagttcctgcttacagagttgcactctttgccctcccacacaccccctacacacacatcatctgctctgcctctctactgtgaaagtttcaacctgggaggcttgaaacaaacagctctaagctgttcacttatattgtatcgtaaaaaataatttttaatgttagtttcatgttcttgtatcattttaaaaatttcccattttaggataactctatttcttgatgttcccatgctctgcaggtatttaataaataaatattatttcaaagagtaagtgactctctattagcccctaaaacatgatgaaatcttttttataagacagaatttcttgttcttcccaaaggaaataaacagacaaaattatgactttatgaaggaaatgatttgatattcccattcccatgtgccactgcattcactagtgtcatgatagcagccagaacagttttattattattttggctaatgtatcttggatgtttacctgttggaaataatcaagcactcctatttattgaagaagtgacccttcatgtttttaaaaagtgaattcatgtatttgtccctggaagcaattatattattttcagtactggttcttaaaaaaaattgattacccctttatcagttctttagttatgtagttcactgtgaatcttctaaaaatagcctaacatttagaatttaagtaaaggttcacttatttacctattcaataaaatttcttcagtggttaataaatgtcaggcttccaaaatatcatctattcctatccgcccatttccgggtgaagaaacaaacaagtccagagaggtcaagggacttgctggagacctcacagtgaattagcgacagagctggtgttggaacccagatctcctgacctaattcagtgactttgtaacactatctctcttctttcttattttctgaagttattctggagcggactttcacctttggtatatttattcttccaataacagataaaaggtcattctctgtcactgtgtttgagctatatgatcttgagcaaattgcttgctctttttgggtcctagtttcttcatcaataaaatggagcaactagactaggtggtctctgaggctctttccagctatgagctctaatttcctatggctctgtgagtcatactgtacacagatcactgattattctcaacacctaatagagaagctgggagagcaaatttctgtggtctatgctatacaaaccactccacctttctctgctctttcagccctcactgcatcagaaatgtcatatttactttcggtctctgttcaaggaactaaagaccactgagggaagagcatgggagggatgttttccaaatttcctaactaccttaaggcagaaagaacatggtcaaagatcttgtcaaagcatccaggcacatcctaatagtatgattgggcaaactgctcaacctctttgccatcaatttgcttgtctaaaatggaaataatgttacctaatttacacgattattttgatgattaaataagacaaaatacataaagtgcttaactgatatctaggtgcttaataaatgttgcctttgctgctcctccatttttatggtatgattcaacttagataaaatgtccagaaatagacaaatctacagaaacagaaggcagattagtggttaccagggtcttgaagagtggtacaggaatgggtggcatggaatttctttttcaggtgatgaagatgttctaaaattgattgtgatggtggcacaccactgaatataccaacaactattgaaccacatacttttttttttttttttcagatggagtctcactctatcaatcacccaggctggagtgcagtggtgtgatctcagctcaccacaacctctgcctcctgggttcaagtgattcttccacctcagcctcctgagtagctgggattacaggtgcctgccaccaggccagctaatttttgtatttttagtagaggtggggtttcaccatgttggccaggctggcctcaaactcctaacctcaagtgatccacccacctcggcttcccagagtgctgggattacaggcgtgagccaccacggctggcctgaattgcatactttagatgtgcgaattgtatggtatttgaattatatctcaataaagctgttaccaaaaaagaatcatgatgaatattgggggaaaaaagggtttattatagatcagtcatccttggatacatctaatctactgacctacagcagagttctggtaagcactgaatgagattatcaatttaagagtactttgaaaaatttaacactgacaaaagaaatgtattcagatgataaaatcataattggagaaataaagaaagacatgaataaatggagacacagtactcctgatgggcaaggctaaaactgtgagaaagacagacaatactctttaagttaatgtatagacttaatgcaataccaactaaatattctacaggatactttacagatcatgacaaacttatagtgaaattcatctggaagaataaaaagacaaagatgccaaaatatcttcttttgtgtaatgatggtagatagtctctcaggttttaaactttattacaaagccacacatatacaaagactctttggcattgggtcaaaagcaaaaattgatcaaggaatagtgtattttagagaaagagagccaaactcttatattaaaaaaattttttctggtaggctaaaacacacacataaagggagcaaaaacaagtaaatgctattgggaaaattagtaagaaaagtgaagctgaatatgtaacacatcatatgctttaataaaattcagatagattaaaagttaaacataaaaatctaagcgtgaaactaggaaaagaaaaacataacagcattgtttctctagctattgtggccattgaaaaaaatgaggtgtcatcaaagccagaatgatgtgttcagaaccaggatggtgggttcaaatatatgactaaaaatcttttgcgtgctgtactatagtaaaatgaagatcaaaaaagaaataatcaaaagggaaaaatatgctgtgagcagaacttttattaggctggtgcaaaaataattgtggtttttaccataaaagtaatggcaaaaactgcaattgcttttgcaccagcccaataaaacacactagtcaaaacaaataaagaaataataaaacatataagatcaatgtatgaagctcacttgatacattctcatggtcaaagagaatggatagcatgcgcagtagagaacgcattgagtataaaattacataacaaaacatacaacttcagcaaaacacaaattaaaacacaaagctttccccaacttggcaggcatgtatataataaagacaactgtttgttaggaaataggtaaccatgtaaattattactggcaatgttcatttccagaacatattataacaatttgcccaggtaatttcatttagatattatatctttcacttccaaagatataaaataaatgaaaataagttatgcaaaaatgttcattatgttgctatttaaatattcatctactgtatacatatatctgtaaatcaccatgttatatgcttaggggattcatttatgtataaggcactgcaatcactgccctcatggaacctataatataacaggaaaggcaatgtatgtttaactttttctttcatggaaataaaggcaaagtactacaggaacaaagaagagggactggggagtggaccagggtggggtggggagaagaaaggtttcatggaggaggtagcactgaacataggccttgaaaggtgagtagagtttgatgaaggatgagagtggttaaaagaggaaagttcattccatgaaaaattccaaatacctaataactgggggatggataaacacacttttggatattaacagactagatatctatgtaatcaccagaaacaaccaaaaaaaaatatatttgtgaactaacttcaagacacataaaaccatgtctgtacattaaaaaggttaggcgggcactcagcatgctggatatccacaatgtttgattcagtaaggttgctcaagttccaaaattttaaaaagtcaacaacactatataaaggtgagtgctaagtcaaacttacaggcatttgctctgatctttctctgggattaaactctcagggtcaggagcgctgtgagcactgggttcctgcaatgtcttcagaaagtaagagtggtagttgcttgtggttaccgcagggggctgtattctgtgcttcctccgctcttatatctcatatgaacacaagttatctgcttgatgggtcactttctcccccaccccaccacaccttcagcctctctccccctcacaccctagcccactaaatcctcttctatttcaacaaaacaatcgcaatgtctagtttcccaaatccgtgcgtaatggtacaggagttaggagtgctcagaacatctgtcttgttttactaagtctactgacggggaaaaagaacagcagccgggattgggaaccttagtttatgtaaccttggaattcatcggctctgatttctgcctgctacattcttacccaaatttattgtgtgttccctctgcaaacataaaatagaaatgtgaaaagcaatttaggattactcaaagaaaaacttgtctctctgcctgaagtttttcaagttataggtcccagtcagacacgtgaaaatagaccagtttttattgtatggtcaaaatcagtggctgtcagtgaaaaggcccatcccactgttgatgccgcctccacactttgtgggatttcaacaaattgcacaaggctatcatactcatctacaatttcttgttatttttttaaggagatcttcagcatttcacccatctcccccaattatttctcctggaaagactgaggcatttagcttcttggacttctctccatataaatggccactcatgggccaactaactgtgtggtgttcaagacaaacaatatacatcatgtaataaagaatcattctcccctgagggaatctgagactaattgaaaggttactgtgtaataggctccattttcttaatcatatcttgtgtttgtgcaaatgttaaaaaaaaagcctcccaccaatgtatttttatccaaatgctgctcaattctattataataattttattgtcctaacatccctgtgaaatcagtaaaccagtgatggaacaaacagctctgcgttggtttgaatcaggcactatgttcaggttcccaaattagaaggagcagtggtcagattgtctgaagagatggacactggccgtggcactaactggttatctaaccattgtctaataatggtcctcatttcctcttttgtaaatcaagagattggagagacaatttgcagaagtttttttccacttctaagattcaatgagtcaaagtttggagacttatttcagaggcaaccagctatgtacaaaatatagcattacaaaatagaaaatatgttggctttgtagcaaaaatacttgggcctgaatcttggatttaccactaactagtagtgttactttggccgagtcaccctctctaatcctcacctttcctctataaaatggaaataaaaagcccttatatgcttattgcgatgattaaataagaaaacatacataaagcaaatggcatgtgacggattctcaataaatggtagccacacttaactgcttcataggccaactggagcattgtctccagaacatatttgtacatttcttacctataaatattctttctatatctaaaaataaacatggatcttctccactttttcaattaaagaatggattatcaagagtgtaattactatattaacaactcgattttacatatgaggaaaatgaagtttatatgactagtccgaagtcacacagagagttaatgacagagctgtctaggatccaggtcatcaaatcccaggatggtatattttacacacccaactgatactctttccaataggccatgttgctattaacagtttgtggtgtcagacaaaaataataatgatttttatacactatattagctaagtctattaagaacagaaaaacagaatactggaaatctgagtaactcaagctaaaacactttttctaaatttcaagacaaaataactaaacaaacagaaacatttgagtaatcgagggagcagcaagacagatgaatgtcactatttgtctccccatatctacctttgtctcccttcaagttagtctgatcatctgaatgaagggtaccactgtttagccagaaacctacaagaaatccttaatagctttatatctccttctatttcacctcctcccttacctaaatgtaaccaagtccttctaattctatcttctaaattcctcttaattctggtcaattctttgtacctcgctttaacaggtcataatcttttctcacctggactactacaacaacctgttacttcgtctccattttttggctgttcttactacctaaaaatcaattatgtatagctagttgatctttttagatgtaaacaagaatatgtaccaaaacttgaaattttatgtagtaaaattttatttgtgtaacttgtcttgtacaccacttttcttcgagttgctaattatctcatttttatttgactaacttgctatatgtatatatctatttttccacaaatgctatcagatgttatgactacaaatatatttttcaaaataataaaatatgcaaaattaatttattcaaaaacttactggatgtctattatgtcctagacactagggatgtatagtcaacaagacagacaatgtccctattctcataaacatgtatactagtggacagagaaagataattagcaaacatataaatatataatacaatgacaatgctataatgaaaatgttaaaggccatgatgaaaaataaataaaagtttatagttaaagagagtgaaccaggcactcatacttatctataaatgacataagataattattttagtggcataaacccatgaggaaaaagaaaaacaggaaagagtatgagacagcaacttttaggaatagaaaggcaaaagagcaaatatcagctgattagcaggcctaataaactggaatcttaaaccagcattgaggaaattaagaacaatttgcaccaaggaagcatcaggtacttccgtaagtgagggcgaaagtggagctgaaaacagagggattggttgaaagatggtttaagaaccaataagcttccaattcccctccttcattattcacagctcatcattaccctacatacttctctcttacagaagagtggagatttagtctctgataaataaaatacagagtgttaggattgggtgtctcatacagagctgagtgtgagattaagtgaacatctagctatatactacatattgagatcaccaaccgtcttttcttacatggctcccaaaaacctagaaccaaggtctatatttcccacaaggaaaagtggaagattatttactgagaaaatctgagcaactttatagtaaattatgtaaaaataattagaagatcaccaaaggaagagagccagctaaatcatcctatagtgacactcaccatgacaaaaacttttaatcagcttttttgtgtcccattcaaacataaccaaacatctaaggattcccagatgtgatttttaaaaattctatgatgaagacaaggaaataaaacaatttaagaaaagagattgcagtgaaatgatcacttacaaatcattaggattattagaaatatgaaagaagacattgtagtcattaaaaagaacagtatactattaaaaatgaacattaaataaaagaactcttagatattttaaatgagagcagaaatgaaatttcactagaagtagtgaaattttatggaaattttatggaaaaaccagaccaaagagacaaaaacatagaaaataagaaataaaatatttttaaaattagagaatcaaaccaggaggtccaacataggaattgtaggttttcatgaaagagaagagagcaaatggaggagacaaaattatgaaataaatcaatcaaaaaatcccagaactgaataaatggtttctagattaaaagggaaattgagttcctaacaaaattgataaaagttgacccacactaaaacacaccatgtttaaagttaagaacattggacaccaagcaaagattatatttgaatgatggaaattgagcagaaaggcaaaggtaagtaagggccagagatgaccataattgcacgggaatgtgtaccactactatatctaacccatcgaagtttacctgctttactctaaaaggatattcagtattcaaaggcttctctctattttcactgttccatcttagtccaatccactattatctttctcttggattactacaatagcctgtaactggtctctctgccttcactctggttccctatagcccatcccccagacagcagccagaagtggaaattgcagtgtaaatcagaccctttctctcctcttcttaatctcccaatggcttttcatttcatccaaaattaaatccaaattcttcacactcgccttctagactctccataatatggcccttgactgccttttgacctcatcattagtctttttcactacttttagccacactgatcttcttcatgttctatgtacatgcccagcacatttacaacttagggcttttgcacctgcaagtcttttccttaagatcttttcatggcttgctccttctcataacttaggtctcagctcatttgtcactttctcagagaaaaatttcctaatcagcttatctaaagtagtcactgagaattctagcaggggcttcaagatagctaactagaagcatcttgtgctcacctcctccactaagaagaaggaaaataatgagtaaattgtcacatttcaaataaatcatccaagagagaatgctggaattcaacagaaaagtgataggaaacacctaaagcaaggacagagaggaaagcaaggcagcctgctcagttgagattggctgaaagcctagagatactccccaatgtgtggaaagagtaagtgagggaccctcagcagactacattcccactgtgaactcctgaaatcctagccacagaaaaactcctagactctcacgggcctgaaattaacatagggagctgcctgtagacaacatgaaagcattgttttagggaatgagctagttctgggtcccacaatcaccccaaatcctaagcagctacagcaaggaaccattttcagagcacagtctctttaataaattgtgctgggaaaattggattgccatatacagaagaatgaaactggacctctattattcaccatatataaaaatcaactcaagatgaattaaagacttgtattagtccatctcgtgttgctataaaggaatacttgagacttgagactagataatgtacaaaaaaaaggagatttatttggctcccagttctgcaggctgtacaagcatttcaccagcaactgctcagcttctggtgaggcctcaggaaacttttactcatggcagaaggtgactggggagcaggcaggtcacatggatcatctccatgattcaaacaccttctattaggccccatctctaacactggggatcacatttcaacatgagatttggaggagacaaacatctccactatattaagacttaagtataagacccaaaactataaaactatgagatgaaaacatagggaaaacacttcaggaagttaccctatatgggctaaaaaggggaggagacttttctggaagctgcccacccctttcccagaaaactcatgaataatccactccttgtttagcatatagtcatgaaataactataaatataatcagttgaacaaaccatgccactgctctgcctatggagtagcaattcttttattctgttactttcttaataaacttgctttaactttaaagaaaaaaaacatttcaggaccttggtctagacaaacattttatgcctaagacctcaaaagcacacacacacaaaacaaaaataggcaaatgaaactatattaaaatcaaaagcttctgcacggcaaaggaaacaatcaacagggtgaacagacaatctgctgaatgagaaaatatttgcaaactatccatctgacaagcaactaatacccagaatatacaaggaactcaaacaactcaacaatatgaaaacaaataatcccattaaaaagtgggcaaatgacatgaataatttgtcaaaagaatacatataaatggccaacgggtatataacaatattcaacatcactaatcattcagggaaatgcaaatcaaaaccacagtgagatattgtgatacaccagttagaatgattagtatgaaaaagacaaaaaataacagatgctggtgaggaaaatggaacttatacactcttggtgggaatgtaaactagtacaaccattatggaagacagtataaattctcaaaaatctcaaaatagaaccaccatacaatccagcaatcccactactgagtatttatccaaaggaagagaaatcggtatgacctacacttgcatgtttattgcagctaatagcaaagacatggagtccactactgcaattgcagtggtaccactctaacagcactcgggctggggaaggaacaagaggcctagtcaatacgttggtacctccagcactctgtagccaccatatagagacgagttcagccccttttcattgagaacccctacctcctactccagctggcagggcccctggctcatgaccacagaactgtcaccccaaccatggctgagcatacccactggtagtggcctggagtttccctagggagaggttttcagaggcatccaacagcccctctgccactgccacagcagcatttccttccctgctgcaatcattctgggaaagaaacaaagagcctgagggttggctcttttcaaatattttttgaaatctttgttcccctgccagctgtctttaaggacagcatgctccctaagtcccacatcacaataaatattatttaacacagaccaataattccatatcacatttgaaaatacacctgagcatctagcgtgccgcagtcaccatatgaagaggagaccaatctctcctctctgtgagccttcaacaccctactccccaacaagctatgagcagtgcagctaccccaccccactgactgaacactcccagtaactgtggctccatgtttcttagaggtggagcccctaggggacacgaaaacctctctgccactgcctctgcagtggtactgcccctgctgccctcagacactgttcagaagaagatatacaagcagccaacaggcatatgaaaaaaaaaagctcaacatgattcgtcattagagaaatgcaactcaaaacggcaatgagataccatctcagatcagtcagaatggctattgttaaaaagtcaaaaaataacagatgctggtgaggttgcagagaaaagggaatgctagccaggcgcagtggctcactcctgtaatctcagcacttcgggaggccaaagcaggtggatcacttgaggttggagttcgagaccagcccggccaacgtgaggaaacccatctctactaaaaatacaaaaaattagctgggtgtcatggcaggtgcctgtaatcccagctacttgggaggctgaggcaggagaatcgcttgaacccgggaggcagggattgcagtgagctgagatcacaccactgcactctagcctgggtgacagagtgagactccttcaaaagaagaagaagaagaagatggagaaggagaaggaggggaaggggaaggggaaggggaagaggaagaagaagaataagaagaggaacaggaagaagaagaagaaagaaaagggaacgggagcatttacacactgctggtggcagtgtatattatagttcagccaccatagacagcagtttggagatttctcaaagaacttaaagcagaactaccattcaacccagcaatcctattacttggtatatacccaaaggaatataaatcattctaccataaagacacatgcacgtgcatgttcattgcagcactattcataatagcaaagacacggaatcaacccaaatgcccatcagtagtagactgaatgagaaaatgtaatacatatacaccatggaattaatgcaaatgcccatcaatgacagattagataaagaaaatgtggtacatatacaccatggaatgctatgtagtcataacaaagaacaagatcatgtcttttgcgggaacatggatggagctggaggccattatccgtagcaaaccaatgcaggaacagaaaaccaaatatctcatgttctcccttgtaagcaggagctaaatgatgagaacctatgggcacatagaagggaataacagacactggaacttacctgagggtggcaggtgggaggaggaaaagaagcaggaaaaataactactgaatactaggcttagcaccaggatgacaaaataatctgtacaacaaacacccatgacacaagtttacctatataacaaaactgcatgtgtacccctgaacctaaagtaaaaaaattaaaaacgaagtcacggagtcaacctaagtgtccatcaatggatggatggataaagaaaacatgatgttacacaaagtggaatactattaggccattcaaaagaatgaaatcatgtcatttgtagcaacatggatggaactggagatcattatgttaagtgaaataagccagacagaaaaaagacaaatactgcttacatggaggttaaaaaagtttatctcatggaggtagaaaatagaatcatagataccagaggctggaaagagtgtgtgcattggagggtagatggagagtttggtcaatgtgtacaaacatacaattaattatataaaagaaataagttataatgcttgataggagagtagggtattatagttagaaacaatgtattgtatttttccaagtagctggaagagagggcttgattgttcccagcacatagaaatgataaacactatggtgatagataccccaaatatgctgacttgatcattatacattatatgcatgtaatgaatattcactatatggaattaataacgtggattgcccctgcaaaagagacccctggagatacagactctcctggattaccaagaacactcagattggtaataatagatttccttttcttacaggtcttatgacaggccttgttagggaggtagtaattgtcttagtctacttagttgggctgccataacaaaaataccatagatgggtagtttaaacaagataaatttagttttgcagcgttctggagggtggaagtccaagatccagttgctagcatggttcctttctggtgagggttctcttcctggcttacagatgatcacctgccttctcattatcattatgtcctcccctggttggggggtaggagggagaagagagagctctctagtgtctcttcttataagggcactaattctatcatgagtgcctcaccctcatgacctcatctaagcctaaacaaacgttccaatctccaaatacgatcatttgtgaggttagggcttcaacatttgaatttgaggaaacacaattcagtccacagcagtaaggaaactgataggggaaagtggcaacatggcaggcaggattattaggggatgcaattgactgaatagaggtcctaatcacattttcttctagatttgtgtatctgtggagctcactgaagaactcttatgtttccaatttgtcaactcccagcactcccttctccattctactaccctcccaaactactctgtgataaatcaaggattgtcatattctaaagtgttccaatgggattaagttccatagacagggaaggaatttcttcgtgtttaatagataagaaatctaatacccatcgtagggaagtaatatgctcatagtctcactgaaaacagtatttcaagccagatttgcgacacatagttcttatcttccagcagaaagcttttccttctgagtacttgtctattttctgaatagacccaggcctcgggttggttatgagataattcaacagagatttataggctgctaaaatgctgggtcactgtaatccatactctgtacttcactgctatttccatctttctggatactctatcccagtaactgaaaattagaaagaggccccctgcccccaaccttgtccaccaacctccaaacatcattagggaagaagtacactgtgtacttgttcccttggcacttcaggtggcaaaattttatcctttctcaggccaattaaaagtttgcaagcactttgttcccctgccagatgtctttaaggacagcatgctcgctaagtcccacatcacaataaatattacttaacataaaccaataattccatagcacatttgaaaatatcaagattactgctgagattgaaacattgactagaaaagagccccaatgatttcctgattatgaagcaattatggatgtggaaactgtcaccttcccaaaactcaagtcctccaggaagcctttcaggattaaaaaccgacccaacattgactactcaattgctccactttgcattctattgtttgttcttgtttagttgttgctttgaaaacactattttgggatgcaaagttgtcaatgtgcatgtgtatgctctctccaactaacttgtgtgttccatatagctgcttctcagtatagtcttgaccgcctgtgctttatgtgttctaaatttcattttcacacgtttcttttcactgatacaataatcagaagttgtggggaagcgtaagaactaaggtttgacaaaatatagctcatgcaacaattaacacatgctgaatagtaaaatgtgataattctgcaacactgggagctaaatggtttaactttgatgcccaaatatctcgcttctaaataccctttaatatttccccatgtcccagtttctcccttatgttgatgccaacaaaaccttaataaagtgatcattgaggtattgacctcagaatgaaagaaaatatgattcttctcaaggacatctacatataagaactcttttataggagatggtaagcaatgaacttgatgtgtgagattagatggaacagggatgctgtaagtaatctggtctttgctgtcccactcttcccagcattttctttcattgttgttaaggatgtttgtgggagaagaagagaaaaaagtaagaaggggcatcattgggcccttggctgccctctgccaactgtgtgagaattggaggagagaggaaacctataggctgcttctctcatttcatttccttttccctaatcctgaagaagaactgcaatattgtctccttctctcattaatgaagcaatgaataagtggatagcctggtggcccacctcagagaggttgccaatgaagcagtagagattggcttcaatttagttgacaagctgttaactgtttctagtgtttttcacaaacttttattagacagattacttaaagctgttttatccattttctccctattttctcatttcttgatctcaaacaagagggtacctccaccactaactccaggtgacctctcttagctaaacactcttctgtaataagccccttacccacacatacaacataggtgaaccgattcgtcagaatgtaattttattgtcatgaactctcttagctggaaattgggaaacttcatgaattatatatcaaaacatatatacaaaatacactgtattcattgaaaagaaattgtactatttctactacccaccttcaagtcatatgcaatcacatttctgccacaacatgcataaatgtatccgactggaaatcatagaattgtcaaatatcagagcaggaagggaatgtagagataatttagcctaaccctctgattttacagaggatgaggtgaataaccagagagaggactttacaaaggtcactcaggtagttgagaacagaagtgagactaaaaccatgggcatgtttatgagtctctgtgtcaaaacaaacatgtattcaaccaaaaactcaagaactaccaaatgaggaagcaccaatcttttcaaagcaacaatgatctcattcatcatgtttgaatgtcccttttcctttctgaactgttttgctgcttgttgtcaattcccaggacacttcccttcccctgcttctgaacagcccccacaaatgagcaattcctaaatgcatttgctatgacgtatgcaaaggctgccactcagagaaaaggtcagtgtcagtgtcctctgtttccaaatatgcctctttttaaaaaatcaggcatagcaatactgaataccaattgcctaaagattcacaaatctcctctaggaaatttcacggctcctaaagaaatggcaaatccaatgaaagttgttatgtgatttaccaagcttaaaaaggaacataaaaggggcatgaatagacaccatttttctactggcccagggaattgtgctgacgggtctgcaagagtcagacatgatgcctcattcctctgtctttatactcagccatctctctagtgccttagaatgtcaagcaggtcccaggcatgctctcaggtcacgagatataaggagtcaggtctctagggagcctccaaagagagaagtgaagacactaaggaaaaaagtaattatttatggccattttgctttgtatttctgatgttagtcctttactggtacttctcagtctgctctgaattctgaattttccacaacacaaaataatacttgctgttttttttcagatgctaccagatatcattaatcagatggttcacacagactttcctgtcatgaacacatcttgctagtcttaccttccaccaccctcttctgtgctatagccatactggacaattctaagttcctgcatacatcttgtactttgaggcctcaaaatttctaccactgtatctttacaaatgatttttctaattctagaatgcccccaacccttttataattcttcaagactcagttcaaaagtcatttcctccttaaagtcttccatgatcacctactgccaccccagattaattcttctatgtataatttctgttctcctgttaattaaattattcacaaattattgagtaccaattatttttcaggcactgtggtaagcattggagatacagcagaagaaagacatggtccctatcctcatacaatttacaaaatagtagaaaagataagtagttgacataaatattttttgtaagagatgtataggtggctataggatgtcactgcaagtgatctaacccagtcttgagaggtcagagaaagtatactcaaagagggagtatttaaattaagacctaaagtcagaacatgagttagcagatgaggagttattgccttccagacagataatacaggcatagaaaaaaacaatgaggcaagaagagacttgaggctctcaaagaaatcaaaagaaggagaaagtaccacaacataaggattcagaagaagaccaggcattataggcttctttaataattgaggatcttttgattattaaaaactcaaaaacaacagatgctggggaggttgtgcagaaaaaggaacacttttagactgctggtgggagtgtaaataggttcaaccattgtggaagatggtgtggtgattcctcaaagccatagaggcagaaataccatttgacccagcaacccattactgggtatgcccaaaggaatataaatcattctattataaagatacatgcctgtgtatattcattgcagcactgttcacaatagcaaagacatagaatcaacctaaatgcccatcaatgatagactggatgaagaaaatgtggtgcatatacaccatggaatactatgcaaccacaaaaagaaatgagatcatgtcctttgcagggacatggatggagttggaaaccattatcctcagtaaactaatgcaggaatggaaaaccaaacattgcatgttctcacttacaggtgggagcttaacaatgagaacacatggacaaagggagggggacaacacacactgcggcctgtgggaggggtgaggggagggacagcatcaggaaaaatagctaatggatgctgggcttaatacctcggtgatgggatgatctgtgtatcaaaccaccatggcacacatttacctgtgtaacaaacctgcacatcctgcacatgtactcctaacttaaagtaaaagttgaagaagaaaaataatgaaggaccttaaactacaaggaacaggaagtcactgaaaagcatcagcatagagactgtttggaaggaagaaaagtacaagcagaagcatcattggtggcttggaatacaatgatggagaaaagtgactacatttgagagatattaaagatggggaatctataggacttaaataattgcatcttaagaaagaaaaatgggagatgtcaaaaatgacaaaaattgatagtgctataattctctgaggcgaggaaaaattgaagagggccaagattggttttaggcagtgggatgggtagataacaagtttggtttggaaaatactgaatttgaggtgcttatgagatatacaagtgaagataacagcaaatagtaaattaggtgtatggctttgaagctcagaagggagagctaaaccagagataagaaactgagagtcgtcatcataaatatggtaattgaagtcatgaaagtggataattttattctaaggagagtagagtgagcaaggaaatctctttgaaatcaaaacaaacatttaagagttatatagaagagccacgaaaagaggtagagatagaatggtagaagagatagaaggaaaaccgggggagtagggtttgcaaaatcaaaggaaagagagtatattaagtaggagactaatcatctgaggtgaatgctgttgagttgccaagaacgaagaatttagcaatgtgagtgtcattgtgaccttatcaagagctatttcagtgaagttgtgtggggcaagcgacagattggagtgggttgaagtgaagaaatggaaacagaaatgtagacaattcaagaaatttgtgtttagtggtagcagtgcaattgttcagtaactgaaagggctaaagaatccagagtgttttgtttgtttattggaaatactagaagatgtttaaaagcctaagcaagaacccagtggagaaatattggttgaagatatagacaagcaagaagttaactgatagcataagtctttggggaaggcaagagggtatgggatctagaatataggtggagggattgtcttttaatagaaggaagtatttacctccttggtaacatgaaggaaaaagagaatagtcaaaatgtctacgtctaaatttggaggtagaattgtctctagatttagtggtggaattttggaggtagagttgagtaggtggtaaagcaatttgctgagattggagggaatgagaataaaatggaatttcgagaagataatttttagccaaactctctggatggaattttttttctagaactccctcctgattattaagagatagtttaatacagtgattaagaacctagaaggccttgggtaaatcacttaacttttttctatcctcagtttcttcattgtgaaaaaaggatcataattttacctacctcataattttataacaaaaataaattaaatgagttattacacatgaagggcttaaaacagtgcctgacaaataataagaactcttgtgttgctttcattctttttgtttgtttgttttaagacagagtttcgctcctgttgcccagactggagtgcaatggtctcggttcactgcaacctccacctcccgggttcaagcgattctcctgcctcagcatcccaagtagctgggaacaggcacctgccaccacacccgactagtttttatatttttagtagagacagagtttcaccatgttggccaggctggtcttgaactcctgacctcaggtgatctgccagcctcagtctcccaaagtgctgggattagaggcatgagccaccgcacccagctgctttcattcttaatgctctctaaatattacctgaatcagtttgctattggattacacggagatgctaaagacaaactattaggcataaaggagggtgaaatttttctttgaatgttgatgttttagttttctaactaaagtataaatgtaacagagatacaaggtttgcttttattcttagttacatatattttttacatctcaggaaatcagtgaataccaatatatcccagtagagaggacttggtccatagaggatggagttgagagttgtttctaataaggagccctgaggcttctgttctaagtcctagggtgattctttttccaaattaaggtgcagagacaacataagcagttgaggttttcaatcctgttccaaacctcttctctgtctttttctgtattagaaggaggaaaggtttacatccatagctgggaaaatcaacaacgatttttttaagccgaggaagtgaaactgtttcgtagctattagctacaaatattagtacaaatagctattagctacaaaacatctggaaagttccataggagggaaacctcaaccccaaaatacaaacatttgctccccacattcattgcaaaagtattgtgccaacttagtgacctgagtataaaggttgaaagactgaagatagacacacacttaattgtaaaagatggtgtaagtttgggcagagtagatgagaacaatcaaatgaaactagctgatatggtgccttgaaggtcggatcaggaatgtgggctgccatactttgctaacacaatctacattaatgaaaagcctggattacatgtacataataatatgccactttattattttcagtacattctgtacagacaaaatggctaagtgttgccaagcagaggtcccaccagacctgatcctgcctgatttataattagcacatttgtttgttagtatgcaaatgagtactgctatagttcttagaaaaaaaatgcgccattgagtaagtgcaacattcttccagcagtcttgctctaaccattcattagtgctaccaacctcttttatcatagaaggtacgaagtaaaacagcaaacttgcaaaagtatgtgagtttatacaatgtcagtttagtgttagacagggaaggcggtatgaaaacatggcaggcctctgtgtaagtagccattgtataaaacggatctcacagtagcatataaaacaatttagataaggtacaaagtggaataagtaaagacaaaccttcccgtttgtaagcccatttgctctaattcggatttatacagatatggcaaaaacaccttcaagttaagattcaaagcctagctccaccacttactagttttgcgactttggctgagcatgatttcatgtcctagaacatcagtgattctcaacaaatattatttattgaccccctccttcacatatctgaagacacagtagtacagtagcaatatagcaatataacaaagtagttcagcaagagagctctgaaattagactgactgagctcagaatcctgactctactacactgactatatatcaatttaatgaacttattcagcctctttaatccttgatttccttatctgtaaattgaacgtcttagtagtcctacttaactcataaggttgtggtgaatatttgataaggtaagccatgtaaagcatttagcagaatgcctacaacatagtaagccctcaataaacacctaactcttaaagtgttaaccctaagctttcttcattttggtttatccccaatgaactccctacaaatggtcttgttaaggacactaagccctacctgtatgttgcctaattcagtggatatttttatattatttttctgcaccatttaatagagataactactttttccttgttgaaatgagaaaacaaggaagacttcaggaagaagtgaaattcatacatgataaaattttggatcagatgctggaaggggattatggagtctctgtgtctggagcactaaaaagtgatcagcagtgtatttgggcactcacatgcccaaaggcaggggctggttcagatcttctctggagatttatttttgcctttagggtctgtgattctcctaaattagagaatgatagcagctactatttgtgcagtaatagctaaaatgcaggcctgggcattttacacgtgtccttgcaatgctcacaaaactcctgtaaagtagatattctccacactttaaaattgattaaatagccttagaaaagcacagataacaatgtcatgaagatagtgagctataattccagaatattctttttttcatttattcactcgttcttgtataaatcaatcaatatttattgatcacctactatgtgacaggcactgtctttagtactaatgtacagcactgaacataaaagataaaatccatgcccttatgcaacttgtattttagtagggggataatatgacccaagagtttctggttccaaggcctcattctgttctataaggtagtataatacactgataggctttcatgtcatgttaccattttacaatgaagttgaactttttccccttttagacacagcagaaccatgcaccaaggaaattgaactactgtctctaaattctttctcctgggaatcacaacaaagcctaaagagcagcagtttatcttcatgctgtttctatgcacgtatctggtcactatggtaagaaatttacttatcatcctggccgttgtcagtgatgctcacctccatggccccatatatttcttccttgccaatctatctttcactaacgtctgcatcacaaccactacagtccccaaaatcttggcagatattcaaagccagaattcaaccatatcctttgaaggatgccctgcacaaatgtagttttaaatattcctggtggatctggataatttcctattggtagacatggcatataattgatacattgccatctgtcacccattacactatatgtggtagtactgagtcccaagaactgtgccctgttggttgtgactccatgggttatctccaaccttgtctcaatactgcatctcagtctgctaagccacttaactttctgtgatttcacatatcttctatgacctggaacccattttagggcttgcttgctcagacacccaaatcaacaacttgataattactgccattggggaagtagttatcttcatcccctttaccttcacattcttgtctcctatggccttattggcagcactatgcttggagttccatcagccaaggggaagtagaaaacattctctacatgtggttcccatctctcagttgtgccccaggtcttctatgggttcatcattggagtctactttctctccttttttgcctactcagcagaaagggatgaggtagctgctatcatgtatacaactgtaactcacttgatcaaatcatttatctgtagtctaaggaacgaggacatgaaaggagcactgaggagaccactcagcagacaaggtttttctggagtggtgagccctgccatagagattctcgtattaaccttttagatttggatgagcacagagaggatccagagtcttaggctagtgtgcttccttggcagtttccttcccatccatttcctgcccctaatccagacccaagactctagatcagactcattttcccatttaaaaaacacaacaacaaaacaaaacaaaatgctcctttatttcacagtcttcaccactcacatacagaactttccctgaataagcacatggttgtatcgtgcttaacaattgttctctattttttagtttctgtctcctccctctaccaaaccctacatgctagattatagataaagaaagaaggaaggaaagaaaaaaggaagggaggaactgatggtgatatctcaaaatagcttttagataataccatgtcaaagttcacaacttccaacctataacttaattctcacaataacactttaaagtaaatattatactgttcccacatactaggcaagaaaaatgatgtactagaagaataaaaaattaaggtgaaaacagtcatgtcacttgtcttactctgagccctactgaggctccccaccaaagtcaaagttcttcagcattgaagatcctctatcacttggacccacctatattttcaggagtatgaatcatcactcactaactcccaccatccttggtacatcctactttctagctacactgaacgctttgtcattccttgagcagtctatgaatttgctatgaatttttagtctacatgttatgtccagtccctgttccactctctcttcctacagacattcaacactttctttaaggctccatctcaagtgttacatcctctgtgaattcttccataattctcacatctttctaggtaaaattacttacttttctcctctatagcactttactttgttattatatagcttagcaaatgaattataattatcacgatatgtatggtgctatccaacatgccctgagctgttttggggaatgatgcagaactatgttttattaatctctgtggttctagtctgagtataatgctgagaacagagtgggtgctcagtaagataaattgaattaaaaagttaccatttttcagaatgaaaatattagcttccttcagaatgaaaatattagtttcattgcctatctgttaagttatcctagatgagtaattaatgtcactgtcccactgatataatccatgacttagttatactaacatctgcctcccagctgcccccattggccatatatctaggacactctggggttaaaaccttttgagacaggaggctaaaaaagtgacatactgggtaggtacaaggagtccaaaataatcaagagggacaaagaaaataagttacaaaacatacacaagaatagaagggcttgaggtacataaggatttttgtatgactatggaagttaaggcatgataccagggcccttttatgccatatctgtataatatcctaatgtttggtcatggaggatgttttaggctattcatgcacctggtaccacaaagacatatcccactgagttatactgcccaggttgaaagaacctggctcattgtttatgacatctttcagggctggattcagggttttgtgattatacaggcaccacattgggtctacccagtgctactcaaagtgtagtttgcagacctactccaaccacacaactatttgttactggccaatagagatattaggtgtgacataagtttagaaactgagactgagcatttagaaacagagagatttcactttccctgaaatttttattttataaaagcattcatctatgaaaacttgaaaattttaaaaagctagtcatctcatacaattagagaaacactggatgattcttctatttcttcttctcctcctcctctttctcctccttcttctttttcttgtccttctcctcctccttctctcctcctccttctctcctcctcctccttctctcctcctcctccttctctcctccccctccttctctcctcctcctctctcctcctcctgcttctctcctcctcctccttctctcctcctcctccttttctcctcctcctcctccttcctccttctcatccttctcctttgtcttcttcaagataaaatcttaagcaggactctgccttatgaatgagtttttagctaattcaatcaggatttgatattgcttagttaattttaaaagtcaactaaagcaaagagtcattaaacctccttacacacataccgttaatacttttttcagaatatgctatcttgacttactccatgtaaagttatattccttagctaatctttggatgtagggccaagaccttttccttgactatgggtcaactgattgagttctgcataaccatttctacataaatcccccccataatatattattcaaaatgcatcagctttggcttccagtttcaatgttttaacaagggaagcaagaacttaaagacaatcacaaagcaagctaaatgtttaatcctccttaggtagttttcaactttgtcttcaatctttcacatctaatttaatacaatatttttagtgacctgcctattttgagtcttttcaatgcatgcaactgttttcatagaaatgactttctttcgtcttcatattttattgtttcatataattttaattaaacttaatttaggtttaattaaacttatggggggtggctggctatacggctgaataggaacagctctggtctgcagcgagatcaatacagaaggtgagtgatttctgcatttcctactgaggtactcggctcatctcattgggactggttagacagtgggtgcagcccacagagggcaagctgaagcagggtggggtgtcccctcacctgggaagcacaacgggtcagggaattccttcccctagccaagggaagccatgagggactgtgccatgaggaatggtgcattccagcccagatactacacttttcccatggtcttcacaaactgcagaccaggagattccctcaggtgcctacaccactagggccctggttttcaggcacaaaactgggtggccttttgggcagacactgagctagctgcaggagtttttttcataccccagtggcgcctggaatgccaacaagacagaaccgttcactcccccggaaagggggctgaagccagggagccaagtggtctagctcagcagattccatccctatggagcctagcaagctaagatccactggattgaaattctcgctgccaccacagcagtctgaagtcgacctgggatgctggagcttggtggggggaggggtgacctccattactgaggcttgagtaggaggttttcccctcacagtgtaaaaaaagccaacaggaagttcgaactgggtggagcccatcacagcttggcaaagccactgtagccagactgcctctctagattcctcctctctgggcagggcatccctgaaggaaaggcagcagccccagtcaggggcttatagataagactcccatctccctgggacagagcacctggggcaaggggcggctgagggcacagcttcagcagacttaaatgttcctgcctgctggcactgaagagggaagtggatctcccagcacagtgcttgagctctgctaagggacagactgcctcctcaagtgggtccctgactcccgtgactcctgactgggagacagctcacatcaggggtcgacagacacctcatagaggagagctctggctggcatctggcgggtacccctctggaacgaagctttcaaagggaggaacaagcagcagtctttgctgttctgcaggctccgctggtgatatccaggccaacagtgtctggagtggacctccagtaaactccagcagaccagcagcagaggggcctgactgttagaaggaaaactaacaaacagaaaggaatagtaccaacatcaacaaaaatgatgtccacacgaaaagctcatatgaaggtcaccaacatcaaagaccaaaggtagataaatccatgaagatgaggaaaaaccagtgcaaaaaggctgaaaattccaaaaacgagaatgcctctcttcctccaaacgatcacaactcctcgccagcaaggaaacaaaactggacagagaatgagcttgacgaattcacagaagtaggcttccgaaggtgggtaataacaaattcctctgagctaaaggatcgtgttctaacccaatgcaaggaagctaagaaccttgaaaaaaaggttagaggaactgctaactagaataaccactttagagaagaacataaatgacctgatggagctgaagaatacagcacgaggacttcgtgaagcataaacaagtatcaatagccaaatcgatcaagtggaagaaaggatgtcagagattgaaaatcaacttaaggaaataaagcatgaagacaagattagagaaaaaataatgaaaaagaatgaataaagcctccaagaaatttgggactgtgaaaagaccaaacctacgtttgatttgcgtacctgtaagtgatggagggaatggaaccaagttggaaaacactctccaggatattatccaggagaacttccccaacctagcaagacaggccaacattcaaattcaggaaatacagagaacaccacaaatatactcctcgagaagagcaaccccaagacacataatcgtcagattcaccaaggctgaaatgaaggaaaaaatgttaagggcagccagagagaaaggtcgggttaaccacaaagtgaagcccatcagactaacagcagatctctctgcagaaaccctacaagccagaagagagtggggggcaatattcaacgtttttttaaaaagaattttcaacccaggatttcatatccagccaaactaagcttcataagtgaaggagaaataaaatcctttacagacaagcaaatgctgagagattttgtcaccaccaggcctgccttacaaaagctcctgaaggaagcactaaatatggaaaggaaaaaccggtaccagccactgcaaaaacctaccaaattgtaaagaccatcaacactacgaagaaactccatcaactaacagcatcctaatgacaggatcaaattcacacataaaaatattacccttaaatgtaaatgagctaagtgtcccagttaaaagacacagactggcaaactggatagagtcaaggcccattggtgtgctgtattcaggggacccatctcacatgcaaagacacacttaggctcaaaataaagggaaggaggaatatatgccaagcaaatgaaaaggaaaaaaaaacacaacaggggttgcaatactagtctctgataaaacagactttaaaccaagaaagatcaaaaaagacaaagaagggcattacgtaatggtaaagggatcaatgcaacaagaagaattaactatcataaatatgtatgcacccaatacaggagcacccagattcataaagcaagttcttagagacatacaaagagacttagactcccacacaataatagtgggagactttaacaccccactgtcaataatggacagatcaatgagacagaaaattaacaaaggtattcaggacttgagctcagctctggaccaagcagacctaatagacatctacagaactcctcaccccaaatcaacagaatatacattcttctcagcatcacatcacacttattctaaagttgaccacatagttggaagtacatcactcctcagcaaatgcaaaagaacagaaatcataacaaacagtctctcagaccacagtgcaatcaaattagaactcaggattaagaaactcactcaaaaccgcacaactacatggaaactgaacaacctgctcctgaatgactactgggcacagaacgaaataaaggcagaaataaataagttctttgaaactgatgagaacaaagacacaatgtacaagaatctctgggacacagctaaagcagggtttagagggaaatttatagcattaaatgcccacaggaggaagcaggaaagctataaaattgaaaccttaacatcacaattaaaagaacaagagaaacaagagcaaagaaattcaaaagctagcacaagatgagaaataactaagatcagagcagaactgaaggagatagagacatgaaaaactcttcaaaaaaatcaatgaatccaggagatgttttattgaaaagattaacaaaatggatagaccattagccagactaataaagaagaaaaaagagaagaatcaaatagataccaaaaaatatgataaagagatatcaccactgatcccacagaaatacaaactaccatcacagaatagtataaacacctctataaaaataaactagaaaatctagaagaaatggataaattcctggacacatacaccctcccaagactaaaccaggaagaattagaaaccctgaatagaccaataacaagttctgaaattgacacagtaattagtagcctatcaaccaaaaaaagcccaggaccagaaggattcacagccgaattctaccagaggtacaaagaggagctggtaccattccttctgaaactattccaatcaatagaaaaagagggaatcctccctcactcattttatgaggccagcatcatccagataccaaaacctggcagagacacaacaaaataagaaaatttcaggccaatatccctgatgaacatcaatgcgaaaatcgtcaataaaaaactggcaagccaaatccagcagcacatcaaaaaccttatccaccacgatcaagtcggcttcatccctgggaagcaaggctggttcaatatacacaaatcaataaatgtaatcaatcacaaaaacagaactaataacaaaaattacatgattatctcaatagatgtagaaaaggccttcaataaaattcaacagcccttcatgctaaaaactctcaataaactaggtattgatggaatgtatctcaaaataataagagctatttatgacaaacccacagccaagatcatactgagtgggcaaaagctggaagcattccctttgaacacaggcacaagacaaggatgccctctctcactactcctgttcaacatagtattagaagttctggccagggcaatcaggcaagagaaagtaataaagggcatttaaataggaagagaggaagtcaaattgtctctgtttgcagatgacatggttgtatatttagaaaaccctatcgtctcagccccaaatctcttaaagctgataagtaacttcagcaaaatctcaggatacaaaatcaacattcaaaactcacaagcattcctatacgccaataatagacaaacagagagccaaatcttgagtgaattcccattcacaattgctacaaagagaataaaatacctaggaatccaacttacaagggatgtgaaggacctcttcaaggagaactacaaaccactgctcaaggaaataaggacacaaacaaatggaacaacattccgtgctcatggataggaagaatcaatatcgtgaaaatggccatactgcccaaagtaatttatagattcaatgctatccccatcaagctaccattgaccttcttcacacaattagaaaaaactactttaaatttcatatggaaccaaaaaagagcccatatagccaagaaaatcctaagaatcctaagcaaacagaacaaagctggaggcatcacagtacctgacttcaaactatacaaggctacagtaaccaaaacagcatggcactggtaccaagacagagatatagaccaatggaacagaacagaggcctcagaaatagctccacacatctacaaccatctgatctttgacaaacctgacaaaaacaagaaatggggaaaggattccctatgtaataaatggtgttgggaaaactggctagccatatgcagaaaactgaaactggaccccttcctacaccttatacaaaaattaactcaagatggcttaaagatttaaacctaagacccaaaaccgtaaaaaccctagaagaaaacctaggcaataccattcaggacataagcatggacaaagacttcatgactaaaacaccaaaagcaatgacaacaaaagccaaaattgacaaatgggatctaattaaactaaagagcttctgcacagcaaaagaaactatcatcagagtgaataggcagcctacagaatgggagaaaatttttgcaatctatccatctgacaaagggctaacatccagaatctataaggaacttaaacaaatttacaaggaaaaaaaacctgtcaaaaagtgggcaaaggatatgaacagagacttctcaaaagaagacatttatgtggccaaacaaacatgaaaaaaagctcatcatcactgctcattagagaaatgcaagtcaaaatcacaatgagataccatctcacgcccgttagaagggtgatctttataaagtcaggaaataacagatgctggagaggatgtggagaaataggaatgcttttacactgttggtgggagtgtaaattagttcaaccatcgtggaagacagtgtggtgattcctcaaggatctagaaccagaaataccatttgatccagcaatcccattactgggtatatacccaaaggattataaatcattctactataaagacacaggcacacatatgtttattgcagcagtattaacaatagcaaagacttggaaccaacccaaatgcccatcaatgatagatggataaagaaaatgtggcacatatactccatggaatactatgcagccataaaaaaggatgagttcgtgtcctttgcagggacatggatgaagctggaaaccatcattctcagcaaactaacacaggaacagaaaaccaaacaccacatgttctccctcataagtgggagttgaacaatgagaacgcatggacacaaggaggggaacatcacacactgggacctgttggaaggtggggggctaggggagggatagcattaggagaaatacctaatgtagatgacgggttgatgggtgcagcaaaccaccatggcatgtgtatacctatgtaacaaaactgcacattctgcacatgtatcccagaacttaaagtataatattaaaaaataaataaataaattttaaaaaataaaataaaattatgattaaaaaacaaatgcaagtaacaaaaacaggttttgggaaaaacacaattgttactttgtaaagtaagacaggattggtggcataggaccataatgatgtgggcatattagaggatagccaacgggctggacgcagtggctcatgcttttaatcccagcaatttgggaggctgaggtgggatgattgcttgaagcaagagttcgagaccagtctgggcaacatgatgagaccccatagctacaaaaaataataaaaaaaaaatagccaggtgtggtggcagacacctatggtcccagatacttgggaggctgaggtgggaggattgcttgagcccaggaagtcagggctgcagtgagctgtaatcatgccactgcactccagcctgggcaacatggcaagtccctgtctcagaagagagagagagactagccaactagttacaattattcactggggtattgccactggcctgaaaatttttcacagagaatggatagtgtctttaatttagagcgtttacatgaagctcagttaagggaaaagttagtgcatattaaaaagatagaagcagagctgttgtgattaaacctgagggaagggacctgggcgcctgccctttagtctactcctcactttaactttggtcatatgtagaaatttggtctctaataggatgcaagaatttatagtagtgatgactacaggttgcccatgccctaaggaagatctcctctcctccctagccccttctgaactactcaagattcttgttgtaggacaaacatatgcagtttctaaactcacttaccaagttgatgacagacaagcaaaaataaaggtatacaaaaaaaggaagtaaagaggtggactgttgccatgccaagaaaataagatttcagttcccaggacctatcataaggccagaagaggccagagcagatcgtgttcagcctaagatgtcggtgagatgacagaaaatccttttctgtagtgcctgtattgcaaatgaaaataccaaagaaaaggccctgcctctatgctgctgattttgccattttggagggaagggagcatttctgaacatgtggcttccagaagacagagactatatcttcttcatttctgaggccctactttccatcccggaccttttcacagagtaggggctaaaactacttatgaaatgaatgaataaaaatttgcccttaagtccaagatcttgggcagaattatgcctgatctgggattttagataaatcaatcacctgatcccaaaatatctggatcttcagtagatctgattgcatattccatagccagaacaaattcatttatagattaagccaacagttgcctacagcatgtaatttgagattcctcaaaaatataaaaaagaaacatgtgacatacttatgcgattttgtatgaagaaatgaggaaactcgatgcctttattacaggtgtatctgctcatgatgctctcaacaccagataaggaagatagctcttgtccctgagagcttacagtgtaatgtagtcttctatacaccatttagcaaccaaagaaagaaacacataaatacattgaaaaatgaatgatgcttttgcattttgaatgagaacagaatgaaatgcctaatggaaattatggagaagcagtttttgtagggtaaattgatagacacagtatctgacagacctggttttaattcttaattctttatttctcaatccaatttttacctgtatgacctagggcaaatcatttcatttatttggtcctcaatttctacatgtgaaaagtgaggttagtaataactatctcaatgatttgttttataggctaagtaaaatattgggtataaagtgcctgtcacataatacattcttattacgtgtgagcttccctctctgtttccttcctttcttctttacatgtttagatgctgaaggtccaaaaggacattacctatattgcaagtcatctggaagtttacctcaagaaggatagggatttaaaacgctgtccaaaagaagtaaagaaaataatttgaaaataaatacagatgtggaaaaaactaaaagagtatgagaattcaaaggaaaatttcagttcaaagtaatttacttatgtatcaaacattttaaaaaataatgtttcttaagcatcttcttgtgtagttcttatgaagactggccttgaactttataaaggagcattttctttcttttttttgggttttgaatttttttattattatactttaagttctagggtacatgtgcacaacgtgcaggtttgttacatatgtatacatatgccatgttggtgtgctgcacccattaactcgtcatttagcattaggtatatctcctaatgctatccttccaccctcccccaaccccacaacaggccctggtgtgtgatgttccccttcctgtgtccaagtgttctcattgttcaattcccacctatgagtgagaacacgcggtgtttggttttttgtccttgcgataatttgctgagaatgatggtttccagcttcatccatgtccctacaaaggacatgaactcatcaaaaggagcattttcaagaaaacaaatcacttgcatttttattaaacaatagataatggggcttaacaaaagaattcttaccatgtagaaaatggatacagtctggtcttggttcagaaaatagttggaagaatgtcacatatataaatataatgtccccatagaagagaatgatagcagttagatgtgaagaaaaagcaagaaaacctttagattcaactacaactgagaagatcctcaagaaagtgacaatgatgaacatgtgggagacaaggatgactggtcaagagctcatccaaatgaagcacccagtgaaaaagaacaaagaattcattatgtaggtgtctgagcaggagaggaccaagagtgggaaactgtcaccaaaaaagctgatgatggtttgaacttacaaaaggcaaatatagagattgaacctcctaaaaacatagtatggataactccatgcccgtaacatgaagccactaattggatacaacaaacttgggacatagtgacaggatagagcatgggttgtctgattggcatataaatgtccttgcccagggaggctaaaagattgcattcagtagtcacaaagaacaaaaataccagcatttgtatcacataataggagaaggaaattgtctctgccaaaaatttcaccactgccttggagactgtggctgggaacaaacagaaatgtctgaagataatttttcaacccccactctctcaacaccctcccccattttggagtcaccagtgtctattatttccattttatgtccatgtgtacccattgtttagctccttgaatccataatagaacatatattttgaaatataataatataatttcaaaaaaactaaaaaataaatctatgaaggataaactttagaggacaaagtacatggtggtatggaaatgggactaactctgataaagatcaggaagccagtttcttacaaacaggactgcataactattcataacagcaaagacatggcatcaacccaaatgcccatcaatgatagactggataaagaaaatgtggtaaatatacaccatggaatactatgcagccataaaaaggaacaagatcatgtcctttgcagggacgtggatggagctggaagccattatcctcagcaaactaacacaggaacagaaaaccaaacaccatgtgttctcacttataagtgggaactaaacaatgagaacacatggacacagagaggggaacaatgcacactggggtctgggcagaggcaggggaaggaagataatcaggataaatagctaatgcatgcggggcttaatacctaagtgatgggttaataggtgcagcaaaccaccatggcacgtttacctatgtaacaaatctgcgtgtactgcacatgtatcccagaacttaaaagaaaataaattttttaaaacaaagaaaaataaaagtcatcttagtgcacagttatacaggaggcatagtcattaaaattttggcaacaaatgatcgaagaatacaactcataagagagtatatataagaacgcagaaatgctctgcatttctacagcagtaaatttcaatgtttctagacatgaaaaatactttctcttttttctttttgagacaggatctcactctgtcacccaggctggattacagtgcagcctcgacttccagggttcaaatgatcctttctcctcagtcacctgagtagctgggactacaggcgctcatgaccacacccagctaattttaaaaaattattttttgtagaaatgcagccgcaccatgatgcccaagttcgtcttgaactcttgagctcaagggattctcccacagaaaaataactgcatataccaagacaaatgcccaaaggggatcacttgtatttgtggatcgtatgtgattccagatgaaacaaattttgtcatcaaattttattagcaaactgtgattctttagtgcatccctgatcacaactgccgcatcttattagctcaacagaagaatgttccattggtaaaaataacaacagttagaatttctgtacacacacagtagtcagtggagatatggagttattaccttggaatatggagtgttaaatacaagaatgcaagtctttatttttagaagcctggaacacagaccttccttcagatctcatccgggaaaacagtgattaacctggtatgtgacgtcagccagatcatttcattgtcccaatacattaactccatagcctctcactactcctacatagaacattgcctgatattttgtatgcagtagatgctttgagacattttcatactctttagttatgcaacaactttgaagaaaataacccaaaaaataacccaaaagaaagaaatagtgtttagaacaaaagcattagttgtgaaggtcactgcattttctatattttgtatagaaatacactgtattttgtatatttcagtatgtagttacgagtgtttggcttctgaagttcattaactcattctatgacctaggaccttggctacgccacgcaatgttttataaactgatgacacaggtatgaaatatataattcctgtcctgaatgagcccacaggttaaacgtgaagatagtctcaatacagggtaagaagtacatgtagggaactgagtactgagtccagataaacgctgaatacatctacagctcctgggtgggactttgggacccagtgacttaagactcctcaagatctcaagctgacattctcagtgctttggaaggtaccattttgagacaaagtattatatctgctaattcaacaataccatagaattgaaattcccaatgtcctctaagatcttgtctcactttgctttcctagacagtcagtaccctacttacttatgctgacatcttacactttccaaagatgcgaacttgcttaaaattaggcatttcttgcacacccaaagaaagtgtccttcaagcactcagcactcacttgtgtgcttttttagtaataaaggcagtgataggaacacaaagcaatggagatgaaccaataatccaggacagagaaattgcttacattcccgggaggggagcacaaaactaagaaaaaaatatatatatgttcactttacatttcacagtcattaaagaaatttttgctaatactatcaaggcaggtcaattaatttaaacatgccattgaaaatggtattttataatgttatttgaaatgaaggagataaaaatgcttgatctgaaaccttacatgtcaattacagaaagctcaccttagactctagtatttacaagagaagttcttaaccatggtttctcatctgaatctcatatgttgatagtggaaacccatgcaaaatccacttagccagaacctctgcatgtaggccctcatcacatgcttttttggtttgagaggtaatcaactttattgaagtataattatcatctaaaaatgcacccgatttaagtgaaagttcaaggagcagggacaaatatatacgcaactaaatatagaactatttccacaaccccagaaagttctcttctgtcccattcgagtcaattcatcccatttttggtcctagacagtcactgatctgctgtctgtaactataaatcagtttgcctcaaatttcatatcagtgaatgaattcatatagtacctagtacgtatgatcttttaaagtatccatgagtgattctgatggagtcaatgttgggaaccactgatatagaggctccataaaggacagaatgaaagatgaccatcatcagctgaatataaaccaaaaggtttagattctagagcatgtgtttaaatcatgcttacaaaattcctatagttcaaaactgaggtccatgaaaattttttggatgaagattaagattgatattaaattacagtttggaatcctgttacatgtctatagctacatagctaagtgaaacacttgtctctcagatccattgtcaaatccaaaatccccctcttttaaattttgcctcaaagtgaagttaaccagataccaaaacatattatttagcagtgtgagtctacagtgtgaaagaggaatgaggactggggctgaggaagcattttaataaacttgaccatgaataccataatagggcttattggcataacctgaatcagtacgtatgtacacaaggccaatgactcattgttatggagcaatggtctggactttgccactattttcatgactgccttctcctttgttctcaagattctccatttgcaaaataaggagcttaaaccatatactttcaaaggcggcctctgacctcaacattctagggttctattttagtgaatttgtcaatgaaaatattgcttaacaccaatgcttaatgttagtctgcaacatttgtaagagtaagctaaacaaaaatctcataggaagagtttgtgtattaaggttattccaggatgaccacaacatttgagtcaggaataagaccttaaaatggactctttcttacagagctaaatgtgtttaaacattatgtggtgtattattttaatattcttttgggagtgagacagaaagccaaaaaagaaagcccctgacccaggtccttcttgttctctgttccgaagaggaacccagtgacatcatgtccatatcttcaactttatctgaagaaattgtaccatcaggcagttaccttggctttacatcttttccttgttaccatgaaaaaataaggaaaggtctacagaaataatgttagttcaacgttttgaatgtgtataggcaatagcatttttctcttttctccatagtgaagcatagtgaaccacttacataataaacattttacacctaaatccagattaatttaatacagatcttcttaaagtattcagtaattcactgggccataaaatttgcttatttaaaaaaagtctatgtaacctaaaaaactatgcctatatttaggcaaccatctcagagatgtgtgttcagagtaaaagaaggggctaatctagagaatttggctagcttttgggggaaaaaatctcatgtgtgcttaagtcacaatgtaaaaaatgcatttcaatgatagtggtattacaacatttaactgtattcatactgatgagaatatctcacaactatcaaaatgaaaaaaacattttgtggaatacatctcaaaaatgctttgtggaaaaacagtaaaatatgatgccattgaaaactgttggaaatacgataaatatttataaatctaacttgttaggatattaaatacctgaaatgcagggaattcagaaacatttgttgtgaaataagacttcccaagtaaaaggacatcaaaaatatcacggaaggttaattataaacatggacacctccccacatgtatggaatgtgaaccaaaagattaagggcagtttccactcatatacgaaaaaataacaagtcatgcatttaagcttaaagaacaccccaattaaagacacaattgaaaaacaaatgtatatatgaagggaaaataaggcccctaaggaagaggaattggaagaaggggccaaggcaagaggatgaaagtgctcggcgctggtcccaggtaaagttatgactctgggcaggtggtctgaggattgcccatttgcagctccatacccatttccctctgacatctctccctgcccactcaggctcctgctctgaccctagcgaaaccctgcttttgggtgaaaacctctagatcatgctcaccacagtacaaaaactaatccagctccatgggctcctgggagtggctggggctaagcaggggagaaggggaggaagatggtgtgcctcttcatggctatcacaccagtgagttcacttaaaggagtctggtgcccctgggagaagttgctgtatgatgcctcccctcccttcctagatctgagtggggctgtgcctggtgatggcccatctctgaaaaaaatgtactgttgagaacaaacgccaattttctggctacgctaataagagctaagtgacgcagtggacaaagcaatgatgctgttcctggctcaatctctctcttcgacaatgataatttgccacatcaagttaccttcccagacacaaagcatcagaggattagctattaaaagaaagacattttctcgctcattacagcctgcaatgtaaaatgtccagaaatacaaggagtcctgttttcaccattaaagtagaaattatttccggcagctttgggagaaaatgcaattattttccttcctgtcacagtgttttcaaactcacctagagatgagagcaccctattaaaatggactcattgttcgaatgatgccagtgaatgcgcttctctgacctgggggtgggagactggctcctgagtcctcaccccttgggattcagggtcactaagggcagaggtaattagacagtgctgagccactgccacttacatgctagtcacaggaagaggaaacttttcaaggaagaaagtgagcagttcaggtagagcccacccattttgctaatagccagagctcacattgccagtttgctgcagacttttttggttgctctattcctggaagtccagtggctccctgccccttgcgaaacctcacagtttggatctgcttagccatgggtctttctccacttgcctgttgccacagggaaagaaagacacccctaactccatctgcactgaaactgagctcattggctttgggcagagctctcaaccaatttggctgttaagcaaagttgctcgaggtggcaggttgcctccctgcagggtccactagactttgttcttgtcactgggctggtcacagtctcagtctctgacccaggtccacttgctctctgttcctaagaggaacccagtgagatcatgtccctatctcagtacaatctccttctccgaagtcaacattctgaagatgacttcggagaatgaagatgacttcggagatgacttcagaatgaagaagagtcaacattctgaagatgactaattgacaccatctggcctcatgagctatcatatcaccatccaagatgaatatccagaataaatgagtaaggagagccccccccgccaccaccacgtcacataccttctcactatgttttcactttagtattgcttctatagtgcaatgggaattcactgctataatataagcataccactgatgaactctgatttataattatttaaagattgttcttgttttggagtggaaaacagattcaaatagaaggcaagggaaaatgagagcttcagtggttggggtatagataatagtgtgagagaggtaataagagaggaacatagagagacgtacaagagaaattttacgtgtaaatacgcagtgtttgttaacgaatttcaaataaggagtaaaggcaaaggagggtaaaaagatgactcccagttttcttgcttgaataacttacttcatgagagtttccttgactgagatagggaagactaaacttgagaacagagtttgggggtaaatctggaagtttcatgaagcaaatcgctttctggccattcctctccactctctccaactctctgatttgacctggtagaaatcaaatctacccggtcaaccttatcttgttaaggccagccaagcacgactcagtgttcacaaagggtagttctgtattcttattttaatgtggacccagcatagactgtgaaaggaatcggttaccgtactggtaattcttatacaatggcaaatatctttttttttttgaacatttaaaaaactatatttactttttaaaggcaaaatggtgacatttttgtatatacaaagataatttgtcaccaacagaaatattctgtaaaatatattcaaggaagttctgcaagaagaaaaatagctggaggtcattatccttgcagactaacacaggaacagaaaaccaaatacctcttgttctcatttttataagtgggagctaaatgataagaacacatagacacatagaggggaacaacagacattgggcctataggagggtggagggtagatggagggagaggatcagggaaaataactaatgggtactaggcttaatacctaatagtctgtacaacaaacactccttgatacaagtttacctatgtaacaaaccagcacatgtacccctgatgttaaaataaaagttttaaaaaagacaaatgtcttgatgcgaaattgaacctaccatccataaattttctttttccttttcgttcgttctttccttccttccttccttccttccttccttccttccttccttcactccctccctccgtccctccctcccttctttctttttctttctttctttctttctttctttctttctttctttctttctttctttctctttctttccttctttccttctctctctctctctctctctctctctctctctctctctctctttctttctttctttctttctttctttctgacagggttttgctctgtcacccaggctggagtgcagtggtgcaatcttggcttcctgcaacttctgcctcctgggttcaagtgattattgtgcctcagccttctgagttgctgggattacaggcacgcgccaccacacccagctgctttttgtatttttagtagagatggtgttttgccatgttggccaggctggtctcaagttcctggcctcaagcaatcctcacgccttgacctcccaaagtgctgtgattataggagtgagccacagtgcctggaccagaaattttcaattagaaaatcacagatgtgtaattcatatatttagatgtttgagatttttctctttcgatccagatatttcatatcctgttgaccacatcttgagctcaccaaagaaactgaagaattgcgtggtcattctaaagaccacttggtgaggtgatgttttcttcctgggactctcatatagcaaaagatcggagttatttgaccacctgcttcattggtgatgcaagtgccagaaccttaggcatctgagaacattattacacttttccctgtcaagggaggatttgtcatggctgtcattcttgaagacatgtaataaaaatgtcatgatctgcttctgtcttaagagagagacaaagcctaggttgccatgacaccaaacaatttaataacaagtggaaatttcaatcaatccattgatcagtcaatcctttcatttccagaaggaacagacaatatatccagaataatatgccttttttaatatcttgaaaggacaaccaaaacattttcatcaactttccatacaatgttacaaatcactgaagcaattatccttccagtttttcatttaactggatagttcaaacaaaaatgttaattttgttgaaatgagttgacacatgttctgaaatccccatatcacctgacacctctgggcaatttaagttgctttcatatttcaagctcataatactaatggaaatcatacctacaataacatagattaactttcagcccataagaacacagcttcccatcactgataaatagggtataagaataatgactgtaggacatgtgtgtgagttgtaactcctgccatgtacatttttttttgtattgagtcagtcatagactcttttcatcccttttgggaaacagtataaatttgtgaaatgcttttgtggagtaagagtaagttggtggtcggcataatgaatggctgtgatgtcaaggccaggatctgtttgtccaccaatctttcctactcctagatcagtctatttatctattattatatcgctgaaagttgtttgaagcagattacagagctaaacataatgcaagatacacataaagacatgagtgaggttaatatgcaagtttatataacaatctatgtacaatggtaagaaatgacccacaaatttagcttggatctacacagtagcaaaagcaaaggggcaaatacaattagagacaagagccccagtgttcacaaaagtattatgaaacaaaattttcatcggaaacagttttcctggtataaaatgcggggagaaatttgtgtggtaggtctttagaaaattggaaaatgtgtcatagagaacaatcctcaaaagcattctgccagtaaagtacaataagtagctagtttcttggaatcgttttaatgatatacttcagtgtaggctgagagtatatgtcaaagggtaatttcattaaagtaattctaagaaaagacaaaataatgtggtctaaatatacatccctctgatgattcagtttgattgctaaaatacaaatctggagaggcaaacgtaatatatttcatttaagctactatacatatcacttttccctctcacacctcaattttaggtaagatatgaacagcaaaaattaagactgtagtctctgatgaccaattgagctaaagattttccaggttgccaattaaggaccacctcttaaatgttaatagtttcctaactagctttgaagtagctatcatgtcatgaaaattacgtagattacttaattatttctgaatggatggccacatattgcatattctccaaaatataagcaaatgggctgacaaagtcccaaagttctatgacatagcccaatatatttctcttaatttaaaaaaaaataacctgtaccattccgtggttttaaatatattcacgaggttgtgtgaccatcaccagtatttaatttgacagtattttcatcaacccaaaagccaccccagacacattagcagtcattctttattccgcccatccttccagccattaatctactttctgtctctatagatctacctattctggacacttcatataaatgaaagaatataatatcttgatttttgtgactgacatctcatagtattcacacgtattcaaggtttatacatcttgtagcatacaccagtaattcatttctttttatggctgaataatatgccattatatggatataccaaattttgttgatccattcatcacttgatggacattttgatttttcccaataactaatattattatgattaatactactataaacattcatgcacaaatttttctgtgaacatatgttttaaattattttgtgtatatacctagaagtgtagttgctgagtcccgtgataactttctgtttgactttttggggaactgtcaaactatattctaaagtaaatgtaccatttaatatttccaccaaaaatgtactgggttccaatttctccactcttgctaccaaatgttattgtctgtcttgttattatagtcgttctagtaggtgtgaagtggtatcttgtggtttttatttgcacatccctaatggccaatgatgtttagcatcatttcttgtgcttactagccattcacatatcttcttcagaaaaatgtctactgaaatctttggcttatttattttaagagacagagacaggatctcactctgttgcccaggctggagtgtagtggcatgatcatacctcactgtaatctcaaactcctgggctcaagtgatttttccacttcagcctccgtaatagccaagactacagatgtgtgacaccacacctggctaattttttaattttttgtaggagacgagatctcccaatgttatccaggctagtctcaaactcctgctttgcccatttttttattttagtttttatttaagcttcaggggcacatggactggtttgttatataggtaaactcgtgtcatgggggtttggatggcccatttttaattggggtatttatctttttattattgagttgcaaaaattctttacatattctgaatacaaattccttttcagatatataatctgttaatattttcttccagcctattcattgtcttttcacattcttgatagtattctttgaagcatagctccaactttgacaaaatggaatttatctttttgttgttgttattgttgttgctagtgttttcagggtaatgtctaacaaaccattgcctaacctaaggtgatgaagatctacacctaggtttttatttaagacacctaggttttatacttttagcttttataataaggcttttgatctcatttgagttaatttttgtatatggtgtgaggtaagagtccaacatcattcttttgcacgtagatatccagttgttccagaaccagttattgaaagactactaataagagctatttatgacaaacccacagctggcacaagacagggatgccctctcacaccattcctattcaaaatagtgttggaagttctggccagggcaatcaggcaagagaaagaaataaagatattcaattaggaaaagaggaagtcaaattggccctgtttgcagacaacatgattgtatatttagaaaaccccatcatctcagcccaaaatctccttaagctgataagcaacttcagcaaagtctcaggatacaaaatcaatgtacaaaaatcacaagcattcttatacatcaataagagacaaacagagatccaaatcatgagtgaactcccattcacaactgcttcaaagagaataaaatacctaggaacccaaattacaagggatgtgaaggacctcttcaaggaggactacaaacaactgctcaacaaaataaaagaggacacaaacaaattgaagaacattccatgctcatggataggaagaatcaatatcatgaaaatggccatactgcctaaggtaatttatagattcaatgccatccacatcaagctaccaatgactttcttcacagaattggaaaaaactactttaaagttcatatggaatcaaaaaagatcctgcatcgcccagtcaatcctaagccaaaagaacaaagctggaggcatcacactacctgacttcaaactatactacaaagctacagtaaccaaaacagcatggtactggtaccaaaacagagatgtagaccaaaggaacagaacagagccctcaaaaataataccatacatctacaaccatctggtctttgacaaacctaacaaaaacaagaaatggggaaagattccctatttaataaatggtgctgggaaaactggctagccatatgtagaaagctgaaactggatcccttccttacaccttatacaaaaattaattcaagatgaattaaaggcttaaatgttagacctaaaaccataaaaactctagaagaaaacctaggcaataccattcaggacataggcatgggcaaggacttcatgactaaaacaccaaaagcaatggcaacaaaagccaaaattgacaaatgggatctaatcaaactaaagagcttctgcacagcaaaagaaactaccatcagagtgaacaggcaacctacagagtgggagaaaatttttgcaacctactcatctgacaaagggctaatatccagaatctacaaagaactcaaacaaatttacaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccgcaatgagataccatctcacaccagttagaatggcaatcattaaaaagtcaggaaacaacaggtgctggagaggatgtggagaaataagaacacttttacactgctggtgggactgtaaactagttcaaccattgtggaagtcagtgtggcaagtcctcagggatctagaactagaaatatcatttgacccagccatcccattactgggtatatacccaaaggattataaatcttgctgctataaagacacatgcacatgtatgttcattgtggcactattcacaatagcaaagacttggaaccaacccaaatgtccaacgttgatagaccggattaagaaaatgtggcacatatacaccatggaatactatgcagccataaaaaatgatgagttcatgtcctttgtagggacatggatgaagctggaaaccatcattctcagcaaactattgcaaggacaaaaaaccaaacactgcatgttctcactcataggtgggaattgaacaatgagatcacacaccagggcctgtcatggggtggagggagggtggagggatagcattaggagatatacctaatgtaaatgatgagttaatgggtgcagcacaccaacatggcacatgtgtacctatgtatcaaacctgcacattgtacacatgtaccctagaacttaaagtatataaaaaatttttgaaatctaaaaaggtaagcctctaaccttgttctttttcaggttgttttggttgttgtcgtccccttgtacttccatgtgaattttagatcagctttccaatttctgaaaaactggtaggtgaaatttgataagtactgtgctgaatctgcagatcagtttgtgaagtattgccattttaatattaattttttttgaggcagagtttcactctgtcacccaggctggagtgcaatggcaggatctcagttcactgcaacctccgccttccaggttcaagcgattctccttcctcagcctcctgtgtagctgggattacaggcatgagccacccaacccagctaattttgtatttttagtagggacggggtttcaccatgttggtcaggctggtctcgagctcctgacctgagatgatccacccgcctcagcctcccaaagtgctgggattacaggggtgaggcaccacggctggcttaatattaatattaagtcttgcaattcatgaaccatttatttaggtcttttaacatttcttttggtgatatcttacagtttttagtatataactcttacacatattttaaaaattactcctaactattgtattcttttgatactattgcaaatgaaattgttcttattttgcttttggatttttattgctagtgtataaatatacaattgattttgtatattgatgttgatagtcataaccttgctgatcttgtttactagctttactagtttatgtgtgtgtgtgtgtgtgtgtgcgcacgtgcgcgcgcgcatgcgcgtattccttagtatttgctatatagattatattgttcgtgaatagagtagttttgcttcctcttttccaatctggatgagttttatttaattttcttgtctgaatgccatggctagaatctagactacaatgttgaatagaagtagtgagaaggaacatccttgtcttcctgatctcatgggaaaagctttcactctttgatcattaagtatgatgttagctatgggttttttgtaatgacctttattaggttaaataacgttcctttctattattattttgttttattatgaaaggctgtcgaattttgtcaaatacttttgctgtgtctattgagatgattctatgattttttggtcctttattctttgaatatggtatactatgttgatttattttcatatgttgaaacactcttgtatttatacagtaagcctaacttggaatgatacataatcctttttggtattgccaaatttggtttgctagtattatgatgaaaattgtttcatccatattcataagtgttattattagtcagtagttttcttttttatgatgtgtcgtgtctgctttaaaaccagtgtgatactcccctcagaataagttggacaatccctcctcttctactttttgcagaatttgtcaaggatttatgttaatttttctttaacggcttggaagaattcacctgtgaaggcactaagcttgggattttccttatggatagttaattgattgctattcattgtaagtctattcatattttctatttcttcttgagtgagtttcagtagtttgtacttttctattaatttgtccttttaatctaggttatgtaacttgctggtgtacaattgttaatagtatcctctactaattattttcatttctgtaaggttactagtaatgccacccctctaattcatgattttagaagttttctcttttcttggcctgtacactaaacttttgtcaattttgtaatatttttgaagaatcaacttttggtgtcattgattttcctcttttgcttttctattgtctatttcatttacttctgtatattctttattatttcctttcttctgcttgctatgggtttagtttgctcttctttctctactttcttaaagtagaagtttgggttattaatttgaggttcttctttgttaatatggagatttacaaccttaaaattctaaatacaactttagctgcatcatataattttggcaggttgtgcttttgtttttattcgtctcaaagtgttttctgatttcctttgtgactttttttctttggcctattggaaagagactgtgtcattcaatctctacgtatttttaatttataaacttttttgctattgagttctaatttcattcaatggtgatcagagaacttcatattactgcagtatttttaaacttggtgaaactttttttattggttagcatataatctatcctggatgctgtttgatatgcacttgaaaatattttgttttctgttcttgttgtgtggagggatccatagatatctgctaggaatagctgttttgttgtgtttcaagtcttctctttctttactttctgtacagttgttgaatttattattgaaagtagactatcgaagtctccaacttttatttttaaattgtctgtttctcccttcaattttgtcagtttttgcttcatttattttggggccctattaagtgtacatatacttacaatcactatgtcttcttggtggattgatcttcttatcattataaaatgtccttcctcatttctagtaacaattttcatattaaagcctattttttctgtgaacattttcatagtgtacccattctagtttgattattgtttgtgtagggtgtctttatcccctttttacttttgacttatttgtgtttttgatttaagatgtgtgtgtggtgcgggtactctttacatgctctggcagccagtttacaacatttctttaccttttaatttcatacttgtgcagagctttcaggtctgccagaagtgtaagtttagggccttcttagtcttccctgggcatggacacggttctacacatgcatatgatcttctagaattctaggaatatataggagcttttggatgccctgcgacccagtttttccttttaagacttttgatcagcttttcatttgccccaatttatataatcatctcaagcagtagcaatgttaaacaattggtattggttgttttcaacaattgtcttgtgtacgatgctgttcacacagaggtgtctttgagtcagatcaaataaagaaaaagcctgtgggtaaaacttttcaaagagctgcaagaaagtccaaatagtgaaatctcccctagaattgaacttttagagaaatccaaaacctttctctatccctccagttacttttaggctgctgcttattacacctaccatgatcatgagactgttgattttcaagactacagagaaattagagaaaagggaatgtgaccaaggtaagttaaaatggcacaaacattactattcttaatgacattcttctatcttttattcttcttttttctcatgtggcaaatcctcagatgagcaataatcttcattttataatgcaatttgagggcttctattttccaatctgacatgtaagtaatcactcccgtccgcacaataagaaaaaagctgaacaaactaaaatcaacagctcttcttagatccataagagcactgatatcacaggacaaatcaataatcccaaaattagagagccaggcaagcagatacagagaatcccagcttactggagcagaaatctccatgggaactagtactggggcagataatcttaaactgtaattagtgaactactggagactcagtgtaagtatgtttgagaatgaaaaattcacagggctaagtccttgttgaggggtcgggggcacacttttgtaaattttacagttacaagccctaccatgtgctcacagtgaagatctgagaaaaattcacttgtgcctctggcagggacaggagaaaagtcattttataatattcccagagcattttgttctttttaacaaggccaaccttcaaggaaaactatttttctaaagcttaaccgattggagatttaccagaaactaaccaaactgggggaaaggaaatatccaacttaatccccacctagacactctgtctcacctaaagaaggtaggactaactgaaaatcaattttgaaggtcaaattccagagacactggctcactaaaagactgagattgctatggtctgaatgttcgtgtctcctccagattcatatgttgacacctaaccctcaaggtaatagtattaagaggtagggctttgggaggtgactaggtcataaggactcttgcctgatggatgggattaataatttaattgtttaaagttaaaaggagcttgtttgtcccttctgccatgtaaagacacagctagaagatgccctctgtgagtgcaccctcaccatacactgaacctgttagcaagttgatgttgtacttcccggtctacagaactgtgagcaacacatttctgttgtttataaattacccagtctaaggtatttgcagcccaaatggactaagacatactcaggattataccaaactttgcctccattcacactttacctccacatcaatagggttagtgcatatttacagagaactacaatggaaagaactacatgtcacagaccttattttaaaagtctctagagaagtccaaagataataggagccacaaaaacaaagatgctaaataaaatttgagcctctgacatttacagctccagaaaacggttaatacaacctgactcctatcaagataaatatcaaagctcacactaaaggccggtttaccttagctcctttaagcaagtacatcatattcagctttcaacaaaaaattacaaggcatacttcaaaaatttttttattatacttcaagttctgggatacatgtgcagaacatgcaggtttgttacattaggtatgcacacgccttggtggtttgctgcaaccatcaacccgtcatctacattaggtatttctcctaatgctatccctcccccagaccccaccacctaacacgctctggtgtgtgatgttcccctcccttttaacaaaaatttatgaaaaattatgagactaaaaaacacaggttgaagagataagatagtgcatcagaaacactcagatatggcagagatattggaataatcacacaaggaatttaaaacaactatgattaacatgccaaaggctttatatggaaaatagacaatatgcaatattagataggtaatgtaaaaagagagatggaaactctaagaaagaatcaaaagaaaaagtttgaaatcaaaaacactagaacagaagtaaagaatctttacttcttgttgattgcccatctttggtgggcttatcaatgggctggacacaggcaaggaaaaaaatgatgtgcttgaagaatgataatagaagtttctaaaatagaaatgcaaagagaaaaagacagaacacgttattcaaaaactgtggggcaactagtaaatgtgcaatatatgcataataggaatacaagatagagaaaaatgatagaaagaaccagaagaattatttgaaacaataatgactaacaatttcccccaaattaatgataaacacaaaaccacaaatccaggaagctcagagaacgacaagcatgataaataccaaaaacatttagatggatcacatttaatctgaagaaaatcaatgacaaagagaaaatcttgaaagaagccggaaagggctaaaataatctaccttacccacagaggagcaaggataaaattacattgaacttcttttcagaaaccatagaaaccatacaagccagaagagaatgcagtaaaatatttaacatattgagagaaaaacaccaccaacctagaattctgtagccagaataactgactgtcaaaagttaagggaaataaagactttctcaggcaaacaaacattgaggtaatttgttgccagtggaactgcattgcaagaagtattaaaataattcttcagaaagaaggaaaattatataagtcaaaaacttggatctacatagagaaataaaaaaattacagagggaataaatgaaggtaaataatattgtttttcttatttttatttatcagataacagtttattcaaaaaattatagcagtaatgtattcggtatttatcacttatgaaatgtgaaatgaattttggtaatgttataaggtaggggaggaagaaatcagagctactttgttatatagtattttctttaaatgtggagtggtatatggttatttaaaagaggacatgtaaaatttatattacaaattcaagggtaattgctaaaatggtttttgcaaagaattataattgatgtgctaagagatgagaaaaaattgaattatatgaaaaaatcaagccagagaagactgaaaaacagtggaagataaaaaagaaaaaacgagcaagagtgaccaatagaaaacagtaacaaatataacagatactaatccaactacatcaataattactttgtatgtcaatagtctaaatatacgaattaaaaaatgaaggtgtcagagttgattaaaaaaaacaagacttgactgtgtgctgtctacagaaacccactttaaatataaaggcacagataaaagtaaagtgatgaagaaacatattaatatggcttggctctgtgtccccacccaaatctcattctgaattgtaattctcaatgttggaggaggggccaagtgggaggtgattgactcataggggatccctcttgctgttcttgtgatagtgagcgagttctcctgagatatggatgcttaaaagtgtatagcacttcctgcttcacccacttttcctcctcctttggccgtgtgaagatgtgcctccttcccctgtgccttccaccatgattttaagtgtcctgaggcttccccagccatgcttcctgtacagactgtggaaccatgagccagttaaacctctcttctttataaattacacaatttagggttgttccttaaagcaatgcaagaatggactaatacacatatcatgcaaacactaattggaaaaagctggagtacttatattagtttcaagcaaatccaacttcagagtaagaaaatagtcggaggtaaggaagggtattacatagtgataaaggggtcaatttttcaagaagatataacaatccttaacgtgtatgtacctaacaacagagtgtcaaaatatctgaggtaaaaaacttgatagaaatgtaaggagaaatagatgaatctactattatagttcaacatgcctccatcagtaattgacaaatccagcagacagaaattcaatcagaacatagttgaactgaatggcaaaatcaattagctggatctaattgcaacctaaagaaaactttaccaaatgaacggttcttctttagctcataaagaatatttaccaagttaaacgacagtctgagacataaaatacagcttaacaaatttaaaagaatagaagttatacaacacatattctcaaccacaataaaattaaacttgaaatcaatagcagaaagatagttggaaaaccctgaaatacacggagattaaataacatatttctaaataacacagggatcaaagaagaatttacaagaaaagtttaaaaatatttagaagtaaatgaacatacaacttataaaaatgtatgggatgcagcaaaagtagtgtttagaaggaaatttatagtatttaatccatccatatattagtaaagaagaaatatctaaaaatcaataatctaagctgtcatcttgggaaactagaaaaaaaagagaaaaattaaattcaaagtgagcaaaagaaaataaaaattagagcagaaatcaatgaaattaaaaatagggaatcaactgagaaaatcaaggaactcaaaagccagttatttaaaaagatgaataaatttggtaaatttgataaatgatacatttgataagtagtatggataaaacatcatccagctcaactaaggaaagaaaggaggcacaaattaccaatatcagaaatgaaatggcggggggaaaggggcccggtggctcatgcctgtaatctcagcactctgggatgccaaggtaggtggatcgcttgaggtcaggagttcgagacctgcctggccaaaatggcaaaaccctgtctctactaaaaatacaaaaattagtcaggtatggtggcacaggcctgtaatcccagctacttggaaggctgaggcacaagaatcacttgaacccgggaggcagaggttgcggtgaaccaagattgtgccactccactccagcatgggtgacagagtgagggtctgtcaaaaaaaaaaaaaaaaacatacacacaattaaatgaaataggagccatcactactgattccacagactactgattccaaggataatacaggaatattatgagcaactcacatccacagagttgataaccttgatgaaatccaccaattcctttaaagatataaactaccaaagatataaactacattcaaagagaaaaagataatctaaataggcctaacctattaaagacattgactcaataactagtagccctccaaaacagaaagcactaggcccatataggatcagcagtaaattctaccaattacttaacaaggaaattataccagttctctacagtctcttacagaaaatagaggcagaggaaatacttcctaatccattgtatgaggccagcattaccctaatatcaaagccagaaaaagacattttaaaaagaggaaaactatagaccaatatctctgatgaacatagatgcaaaaatcttcaaaaaaattagcaaattggatctaacaatgtataaaaacagttatacaccataaccaagtgagatttattccagatacacaagcctggttcaagattcacaaaacattgtaattgatcatatcaataggctaaagaagaaaaatcatatgatcttatcaatatatgtagaaaaagcaattgacaaaatccatcatggatttatcataaaaactctcagaaatctacgaatagagagaacttcttcaacttgaataaacctacagttaacacaagacttaatggtgacaaaccagttgcaatcttcctatcaccaggaacagttaagggttgatccctcttaccactactattcaacatcatactggaagttcaacctattttaataagagaagaaagggaaataaaaggtatacaaattgggaagaaagaaataaaattgtctctgtttatagataacatgtttgtctatatagaaaaccccaaagaatcaaccacagaaaagtcttggaaataaaaaaccattatagcaaggttgcaggatacatggccaaaatgcaaaagtcaattgatttcttatattccagcaataaaaaattagaatttgagattaaaaacacattaccatttacatgagcataaaataatgaaatactcaggcatgattctaccaaaatatgtactagatctatattgggaaaactaaaaagctgattaagcaaactgaaggaaatctaaataaatggagatattccatgcacatgaagaggaaaattcgatattgtcaagatttcaattctttccaccttgatctagagattcaatgcctcccaatcaaaatcttagaaagttattttgtgaatatcaacaaactgattctaaagtttatatggaaatagaaaggattcagaagagtcaacacaatattgaaggagaaaaacagtaagaggactcatattacccaaattcaaaacttaatataaagccacagtaattaagacagtgtggtattggcaaaggaatgaacaattgattaatggaacagaatagagagccctgacatagactcacatgaatataatcaagtgatttttgacaaaggaacaataccaattcaataaagaaactgcagtcttcacaagaaatgatgatggaacaactggacaaacacctgccccccaaaatgaacctagacacagatcttaaacacttcacaaaaaatgactcaaaatagctcatggagctaaatgtaaaatgcaaaaccataaaacatctagaggataacataagagaaattctagatgaccttgggtttggtgataactttttagatacaacagcaaaaacatgatccatgaaagaaaaaaataatgaggtggacttcattaaaattaaaagcttctactctgtgaaagacactataaagagtgtgaaaagacaagccacagattgggaaaaaatatttgcaaaacacacatcaaataaagagttgggggttccaagatagccgaataggaacagctccagtctacagctcccagagtgagtgacgtagaagaagggtgatttctgcatttccaactgaggcaccaggttcatctcactggggcttgtcagacagtgggggcaggacagtgggtgcagcccactgagcatgagccaaagcagggcgaggcactgcctcacgcaggaagcacaaggggtaagggatttccctttcctagccaagggaaggggtgacagacagcaattggaaaattgggtcactccaccctaatactgtggttttccaagggtctcagcaaaaggcacagcaggagattatatcctgcacatggctctgagggtcccacacccacggagcctcactcattgctagcacagcagtctgagatcgaactgcaaggcggcagcgaggctgggggaggggaccccgccattgcccaggcttgagtaggtaaacaaagcggcctggaagctcgaactgggtggagcccaccgcagctccaggaggcctgcctgcctctgtagactccacctctgggggcaggccatagccgagcaaaaggcagcacaaacctctacagacttaaatgtccctgtctgacagctttgaagagggtagtagttctcccagcacggagtttgagatctgagaatggacagactgcctcctcaactgggtccctgaccccgagtagcctaactgggaggcaccacccagtaggggcagactgacacctcacacggccaggtacccctctgagacaaagattccagaggaacaatcaggcagcaacatttgctgttcagcaatattcacggttctgcagcctccgctgctgatacccaggcaaacaaggtctcgagtggacctccagcaaactccaacagacctgcagctgaggctcctgactgttagaaggaaaactaacaaacagaaaggacaaccacaccaaaagcccatctgtacgtcaccatcatcaaagaccaaaggtagataaaaccacaaagatggggaaaagacagagcagaaaaactgaaaattctaagtatcagagcacctctccccctccaaaggaacgcagctcctcgccagcaatggaacaaagctggatggaaatgactttgacaagttgagagaagaaggcttcagatgatcaaacctctctgagctaaaggaggaagttcgaacccatcgcaaagaagctaaacaccttgaaaaaagattagacgaatggctaattagaataaccagtgtagagaagtccttaaatgacctgatggagctgaaaaccatggcaggagaactacgtgatgaatgcacaagcttcagtagccgatttgatcaactggaagaaagggtatcagtgactgaagatcaaatgaatgaaatgaagcgagaagagaagtttagagaaaaaagaataaaaagaaacgaacaaagcctccaagaaatgtgggactatgtgaaaagaccaaatctacgtctcattgatgtacctgaaagtgacagggagaatggaaccaagttggaaaacactctgcaggacattatcctggagaacttccccaatctagcaaggcaggccaacattcaaattcaggaaatacagagaatgccacaaagatactcctcaagaagagcaactacaagaaacctaattgtcagattcaccaaagttgaaatgaaggaaaaaatgttaagggcagccagagagaaaggtcgggttacccacaaagggaagcccatcagactaacagcagatctcttggcagaaactctgcaagccagaagagagtgggggccaatattcaacattcttaaagaaaagaattttcaacccagaatttcatatccagcaaaactaagcttcataagtgaaggagaaataaaatactttacagagaagcaaatgctgagagattttgtcaccactagccctgccctagaagagctcctgaaggaagcactaaacatggaaaggaacaaccggtaccagccactgcaaaaacataccaaattgtaaagaccatcaatgctaggaagaaactgcatcaactaacgagcaaaataaccagctaacatcataatgacaggatcaaattcacacataacaatattaaccttaaatgtaaatgagctaaatgctccaattaaaagacacagactggcaaattggataaagagtcaagacccatcagtgtgctgtattcaggagacccatctgaaatgcagagacacacatcggctaaaaataaagggatggaggaagatctaccaagcaaatggaaaacaaaaaaaggcaggggttgcaatcctactccctgataaaacagactttcaaccaacaaagatcaaaagacacaaagaaggccattacatagtgataaagggatcaattcaacaagaagaactaactatcctaaataataatggaagactttaataccccactgtcaacattggacagaacaacaagacagaaagttaacaaggatatccaggaattgaattcagctctgcaccaagcagacctaatagacatctccagaactctccaccccaaatcaacagaatatacattcttctcagcaccacatcacacttattccaaaattgaccacatagttggaagtaaagcactcctcagcaaatgtaaaagaacagaaattataacaaagtgtctctcagaccacagtgcaatcaaactagaactcaggattaagaaactcactcaaaactgcacaactacatggaaactgaacaacctgctcctgaatgactactgggtacaaaatgaaatgaaggcagaaataaagatgttctttgaaaacaatgagaacaaagatacaacataccagaatctctgggacacatttaaagcagtgtgtagagggaaatttatagcactaaatgcccacaagagaaagcagaaaagatctaaaactgacaccctaacatcacaattaaaagaactagagaaggaagagaaacacattcaaaagctagcagaaggcaagaaataacaaagatcagagcagaactgaaggagacagagacacaaagaacccttcaaaaaaatcaatgaatccaggacctggttttttgaaaagatcaacaaaagtgatagaccgctagcaagactaataaagaagaaaagagaaaaatcaaatagatgcaaaaaaaaaaatgataaaggggatatcaccaccgatcccacagaaatacaaactaccatccgagaatactataaacacctctacaaaaataaactagaaaatctagaagaaatggataagttcctgaacacatacaccctcccaagactaaaccaggaagaagttgaacgcctgaatagaccaataacaagttctgaaattgaggcaataattaatagcttaccaaccaaaaaaagtccaggaccagacggattcacagccgaattctaccagaggtacaaggaggagctggtaccattccttctgaaattattccaatcaatagaaaaagagggaatcctccctaactcattttatgaggccagcatcatcctgatatcaaagcctggcagagacacaacaaaaaaaagaattttagaccaatatccctgatgaacattgatgcaaaaatcctcaataaaatactggcaaaccaaatccagcagcacatcaaaaagcttatccaccatgatcaagtgggcttcatccctgggatgcaaggctggttcaacatatgcaaatcaataaacataatccagcatataaacagaaccaaagacaaaaaccacatgattatctcaatagacgcagaaaaggcctttgacaaaattcaacagccttcatgctaaaaactctcaataaactcggcattgatgggacgtatctcaaaataataagagctatttatgacaaacctacagccaatatcatactgaatgggcaaaaactgggagcattccctttgaaaactggcacaagacagggatgccctctctcaccactcctgatcaacatagtgttggaagttctggccagggcaatcaggcaagagaaagacataaagtgtattcaattaggaaaagaggtagtcaaattgtccctgtttgcagatgacatgattgtatatttagaaaaccccatcgtttcagcccaaaatctccttaagctgataagcaacttcagcaaagtctcagcatacacaatcaatgtgctacagtaaccaaaatagcatggtactggtaccaagacagagatatagcccaatggaacataacagagccctcagaaataaaactgcatatctacaaccatctgatctttgacaaaccagacaaaaataagaaatggggaaaggattacctatttaataaatagtgctgggaaaactggctagctatatgtagaaagctgaaactggatcccttccttacactttatacaaaaattaattcaagatggattaaggacttaaatgttagacctaaaaccttaaaaaccctagaagagcaccactgcacaccagcttgggtgatagggccagactctgtctcaaaaaaacaaacaaacaaacaaaaaaaaacccctagaagaaaatctaggcaataccattcaggacataggcatgggcaaagacttcatgactataataccaaaagcaatggcaacaaaagccaaaattgacaaatgggatctaatcaaactaaagagcttctgcacagcaaaagaaactaccatcagagtgaacaggcagcttacagaatggcagaaaatttttgcaatctacccaactgataaagggctaatatccagaatctacaaagagcttaaacaaatttacaagaaaaaaacaaacaaccccatcaaaaagtgggcaaaggatatgaacagacacttctcaaaagaagacatttatgcagccaacagacacatgaaaaaatgctcatcatcactagccttcagagaaatgcaaatcaaaacaacactgagataccatctcacaccagttagaatggcgatcattaaaaagtccggaaacaacaggtgctggagaggatgtggagaaacaggaacacttttacactgttggtgggactgtaaactagttcaaccattgtggaagtcggtgtggtgattcctcaaggatctagaactagaaataccatttgacccagccatcccattgctgggtatatacccaaaggattataaatcgtgctactataaagacacatgcacacgtatgtttattgcagcagtattcacaatagcaaagacttggaaccaacccagatgtccatcaatgatagactggataaagaaaatgtggcacatataaccatggaatagtatgcaaacataaaaaagtatgagttcatgtcctttgtaaggacgtagatgaagctggaaaccaccattctcagcaaactatcgccaagggcagaaagccacacaccgcattttctcactcatagttgggaattgaaaaatgagaacactgggacacagggccagcaatatcacataccggggcctgttgtgggttgggagaagtgggagtgtaacaaacctgcatgttgtgcacatgtaccctagaacttaaggtataataataataataaaaagactcaattctacgtatagcttatcttgggctaggtggaatctgtcatttacagagtgatcatcctcatcatgagtcctattatccatagctcaagaaaccaggaggtgtaatggttactagacagggtcctgtgtaaattttcatcacctcaagaatgactaaatatagctggttgtttactcttctaattttaattctgttggtttaaaacgtgaggagaaagcctccacacagcacattcaatgtgctctggtgtatggccacagactcccttgattttagattattcaatcctcttaatttacactgtattggtagtactctttcatgttgtacaaaggattttatagttccaattttgaaaagcacctaatgaaaattcttaactccaaactatttaaatattactctgaataatggtctcgaatacttgcaatttgtttactcttacaattgtactactaaagtctcatttttgaactcagaatatagactattaaattattttaaacaggcaacttcattactccacccaaatgatagaccttattaaccatccatcattaatgcatgccagtctccttgacaaaatgcaaatcttggattctcaagcaaatgtttacaagatgggcaggtaggatctcagaatggcaatatgctaatgagaaattttatatttctatcatcttgtaggattatccactgggaaaatcataagatcatttgtatctcttattgactattatttgatatttgatgtatggaaacaagttgtatgagtatatgaatacagtatggaatgctggctagtgattcttatatagaacctctactgtagtaccacgaagagtcattagatacacagtttttaaagagatacagaacaattttgaataaagtggcatgtgttttggccactctttcttttaaaatttgttttgatgactggagaccactttggacaatttggattcacaaactctgtcataaaaaaagaaggataaacattcttctatatgcagatgatttgattttactgcagaaaactaagattaatttcaaaagacactgtccctgccgtctaaatactgtcagtgctaatggcttcagatcagctctcccaaaatccaaaccattatttttagtagaaatcttccaatatttaagcggcttatgaataacagccttatacagcatgaccatgtatttggttatgactatgtattagttacattgtaatcattggcatatgtattctctctgtaaattcaccaagaaattacattgttttgcttttgcgttaaatgagatgttctataattgctttgttgaggtttttttaaaattactatagtgggtaattagtaatacttgctttagaaatattgaacactagaataattgcagatatgccatataagtgttgtttttaaattatatgtttttaaattaatagactatttttaagaacagttttaggtttacagaaacaattgaacagaaagtacagagagttcccatatacttccctagccccctgagataatttcccctattagcattttgcattagtatggtacatctgttataattgatatataaatatggatgcagtattaactaaagttcatagttagcattagagttactcttagtgttgtacattctacggatcttgacaaatgtatactgatatgtatccacaattacagtataacacagaatagttttattgccctaaaaaatcctccttactccatctgtttattcctccacccctttcctccaaagcctggcaaccacttatatttttactgttttcatccttttccctttccaatagtgctgtatagttggaatcatagtgtgttgccttttcagattgatttctttgacttaacaatacgttcttaacattcatctacgttctttagtagcttggcatcttgtttctttttattgctgaataatattctatggtatgtatgtatcacagtttgtttatccactcaactattgatattgaaaggcatcttggttgctttcaagttttggcaattatgaataaacatgctgtaaagatttgtgtgcaggtttttgtgtaagcagttttcttctttttttaaaattgtataaatgtaaggggaacaagttcaacaactaattttggtaagtactaagagatacaattgctggatcatatggttaagaatacattcaattttgtaagaaactgccaaactgtttgccagagtgactataccattttgtattcccagtcagagttactgttgttccacatcctcatcagcattcagtattgtgttataaattttagctattttaatatctgtataataagtatctcattttaaattgcaattccctgatgacttgatattgagcatcttttcatatgcttgttatttgtgtatcttttttactttcgttttttaattttaattttctaacttttaattaaaaataaaaattgtatatattgtatatgggttacaacgtgatgttttgatgtatatttacattatagaatgactaaatcaagctagttgacaaatccatcaccttacatacttctcatttttttcataatggaaacatttaaaatttacttttagcagttttaaaatatacaaatgcattattatttattataatcaccattccgtatgatagatcactaaagcttattcctcctgtctaactgaaattctgtaccctttgatcaacacatctcctttcctcgcctattgccctctctcagcctctggtaatcatcattctaccctttctttctatgagtttcacttttttagattgcacatttaaatgagatcatgtggtatttttatttctgtgcctagcttatttagtgtaacataatattctctagtttcatctatgttgtcgcaaatgacaggacttcattcttaaggctgaatagtattccattgtctatatatgctatattttctttatccattcatctgatgacagacacctaggttgattccttattttagctattgtgaataatgtaatgaacatggggttgcacatatctctttgacatactgattttatatttttgggatatgtacctaaaagtgagatttctggatcatatggtaattgtatttttaatttttttgagaatcttcatagtgtttttcataatgactgtattgatttacattcccaccaacagtgcacaagtgttcccttttctctacaccctcaccggcacttgttatgtccagtctttatgataatagccattataacaggtgtgaggtgatatctcattgtggttttaatttgcatttcacagatgattaatgatgatgagtatttcttcatgtacctattggccatttgtatggcctcttttgggaattgcctacttaggtcatttgcccatttttaaattatgttatttcttgttgtttgctattgagttgagtttcttatataattttaatattagctttttatcatatatatggtttgcaaatattttctttcaatctgtgggttttctcgtcactccttttttttgctgtgctgaagctttttagcctgatgtaatttcattcatttaattttgattttgttgcctgtgctgtgtatcttttaaggtgaggtatctgtgcagatctgtgtttttaaaatttcattggttgtattcttattgttgagttttaagatgtctttgtatgttttgaataccaactctttttttttatactttaagttctagggtacatgtgcacaacgtgcaggtttgttatatatgtatacatgtgccatgttggtgtgctgcacccattaactcgtcatttagcattaggtatatctcctaatgctatccctctcccctccccccaccccacaacaggccctggtgtgtgatgttccccttcctgtgtccaagtgttctcattggtcaattcccacctatgagtgagaacatgcagtgtttggttttttgtcctcgcgatagtttgctgagaatgatggtttccagctttatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaatgaacatacgtgtgcatgtgtctttatagcagcatgatttcactctgctggtagtttcctttgctgtgcagaagctctttagtttgattagatcccattggtcaattttggcttttgttgccattgttttggtgttttagacatgaagtccttgcccatgcctatgtcctgaatggtattacctaggttttcttctgcggtttttatggttttaggtctaacatttaagtctttaatcgatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatggctgtagatgtgtggtattatttctgagggctctgttctgttccaatggtctatatatctgtcttggtaccagtaccatgctgttttggttactgtagccttatagtatagtttgaagtcaggcagcatgatgcctccagctttgttcttctggcttaggattgacttggcaatgcaggctcttttttggttccatatgaactttaaagtagttttttccaattctgtgaagaaagtcattggtagcttgatggggatggcattgaatctataaattaccttgggcagtatgtgtcctcttttatttcactgagcagtggtttgtagttctccttgaagaggtccttcacatcccttgtaatttgggttcctaggtattttattctctttgaagcaattgtgaatgggagttcacacatgatttggctctctgtttgtctgttattggtgtataggaatgcttgtgatttttgcacacggattttgtatcctgagactttcctgaagttgcttatcagcttaacgagacttggtgctgagatgatggggatttctaaatatataatcatgtcatctgcaaacagggacaatttgacttcctcttttcctaattgaataccctttatttctttctcttgcctgattgccctggccagaacttccaacactatgttgaataggagtagtgagagagggcatccctgtcttgtgccagttttcaaagggaatgcttccaggttttgcccattcagtatgatattggctgtgggtttgtcatagatagctctcattattttgagatgcgttccatcaaaacctagtttattgacagtttttagcatgaagggctgttgaattttattgaaggccttttctgcatctattgagataatcatgtggtttttgtctttggttctgtttatgttatggattacatttattgatttgcgtatgttgaatcagccttgcatcccagggatgaaacccacttgatcatggtggacaagctttttaatgtgctgctggatttggtttgccagtattttattgaggattttcacatcaatgttcatcagggatatcggtctaaaattctctttttttgttgtgtctctgccaggctttgggatcaggatgatgctggcctcataaaatgagttagggatgattccctctttttctattgattggaatagtttcagaaggaatggtaccagcttctctttgtacctctggtagaattcggctgtgaatccatctggccctagactttttttcgttggtaggctattaattattgcctcaatttcagaacttgttattggtctattcaggtattcaacttcttcctggtttagtcttgggagggtgtatgtgtctaggaatttatctatttcttctagattttctaatttatttttgtagaggtgtttatagtattctccgatggtagtttgtatttctgtgggatcggtggtgatatcccctttatcttttttattgcatttatttgattcttctctctcttcttctttattaatcttgctagtggtctattttgtttatcttttcgaaaaaccagctcctggattcattgattttatgaagggtttttgtgtctgtgtctccttcagttctgctctgatcttagttatttcttgccttctgctagcttttaaatttgtttgctcttgcttctctagttcttttaattgtgatgttagggtgtcgattttagatttttcctgctttctcttgtgggcatttagtgctataaatttccctctacacactgctttaaatgtgtcccagagattctggtatgttgtatctttgttctcattgttttcaaagaacatctttatttctgccttcatttcattttttatccagtagtcactgaggagcaggttgttcagtttccatgtagttgtgcagttttgagtgagtttcttaatcctgagttctaatttgattgcactgtggtctgagagacagtttgttgtgatttctgttcttttacatttgctgaggagtgctttacttccaactatgtggtcaattttggaataagtgtgatgtggtgctgagaagaatgtatattctgttgatttggtgtggagagttctgtaggtgtctattaggtccgagtcttaaatatgtatgtgtgccattaaaaaattgctgacagtagcaaattataatggacagatagagaagtctttgtgcttcccttcagctaactaaatctttatattgaccacaatgataaaattatggggaccaggactatgatcaggaagctgagatggagatcagaaactcacaaatgtgcaggataaatctaagagcaagagaagatcagagaagttgttcaccacattggatctgccaaagaagagctaagacatagtgtttgatgttgttattgaaatacatactctcttattgtaatgagccgtcagaattgaaattaaaagcttttaatgtgagaattgggtagagaatgggttacaaataataatatagcaatggcagatcctggaggccaaaagctaaaattctgcagtaacaacaaaaatgaacaaactgagttttgacccataacaaagcaatgagataaccttaagcagaaatagaatgtttactgtcctccttaggaaaattcttgaggaataatacatgcaggaagagacaaacaggagtttctatgtcttggatatgtcagaaattcctgaaagtaccaaatttcttttactccttcctatcaggtcaggatgctgtgtcagacaaaaaaaaaaagattgtcattctcatcaataataataagatgagaatgtaggcactcaaatcagccaggtgaatatataatttctactttctctaccttctaagtgtggtctgtggttatctcatctgcagaatgagtttgacaggttacggtaaaaattaaatgagataatatatgcaatattctttgagtattgcctggcacaaagtaagttccaaaccagtttctgtgaaaaaaatttatcagcatcattttattaacatggttttcttaataataataaaaaaaagcagagaagcactcaatgaccaaaaatggaccctgtaaaaagggtgtgaagtctcttgccctcaaagaggttctaggttaagacactatcacactgatacacagaaccttaaggaagattgacaccagaaattaccatcaagtgcagtttttcaaagaaactaggctaccagcacagtgactcttgcaatgcctttaacctgtgcttctaggtgaagttaactaccttgtattattagacctttatgccctattagaactgtcttggtgagaggcaaaatacagcttttggtgtactgcagcaaagtgtaatggatgacatacaaaaactgcgcttagaagctaggagacaatgagggaatagtagattgtagaactaataacaaatagctcctcctagtagttaactcttccactgtgtttattccataccactagctgttaatatcactagatgattttaacgaatactttgataaacgttcgttgatattgaaggtgtctctttgcagaaacatagcaagtcctcttccctgctgctattcatttgcatttataatgcattaattgaatatttatttttgtaaaccacttggctaggcactgtggcaggttatgggaagaacatgacattgatcctgactttaagggcctgagaattaataaggggaggtaagacatgagtgcaaagctcaccaggtcagagtaaagaatggagaggttctaataatgcggctgaagcacatggtgaatgatgagaaaggacgaaagggatttagaagtccttgaagggagttaatatttgcatttgtgattatttgagaggagtgctttagacatgaagaaaaacactgcagcagtaaattttaggaaatgtttggaaaataagaaaataatctcataaggttgaaagggcaggtgggaagagactctgagtgacatgtcaaaggttgcttttaaaaacatgtcagaggctcctgaatgtcatgacaaagaatttaaaaatgtttttgtaggcaacaagtagccagagaagatttctgagcagaaaattgtacagccagacatatgctttaggaaagctaacatactaataacaagtagaatggattgggagccagaaagtctggaggcaaaaacaaacaaacaaaaacaaaaagcaaaacacaaattgcatgatgacttcaacagtctgatgaaagcttactagactgtgaacaaggagattagaagtaggaaaagaaaggagatgacaaagtcaagagatgttgaaaatgtgtaattgctaggctttcatgatggatgggatgtgaggaacatgagagatggaagtgacaaatatgactgtcatattcagtctggctgactggaaagattgaaatatcattaatggagacaaggaacacaagaagaagaaaaggaatggaggtgttgatgatgtgtttgatttttaaaaacagctctgaagaggaggacttctcaaactttaaggtacatgcgaattacatgaggattttgctaaaatgaagattgattcactaggtgaggagcagagtttgagattctacatttataacaagcttacaagaaaagtcaatatcactgggcctcagatcacactttaaagcagcaaggctgcagaggatagcaggctcaatagtcagggagaattttggtagaataaggcaggcctgcccagtagaagtgccaagaaatatgtttgagcaaaatactaatttaaaaatctatataaaaggaaaaaacatactttaggccaaatacattttttaattagcacatttagttttaaagtacttgtaactgttttgctacttattcaaagtatccatatgcatgtatgcatactcattcttcagcttcacacatacaacaaacatatacaattttttactcattacataattttatttcatagaaattcctaataaacacctaagtgtcttggggaaagccaatatctacgctgacaaattaagatggagaactaagaaattaatccttttttatcatatcatttttacataaaggactcacaaaacggactctaagttgctctctccatccccacacattcagaataaatgtaatcatatggacaaataattctttcatcttgtaattctaagactgaaatgtgaattacctttatatggtacctcatcactagtcagtaagtgaacattttggtcagatacaatatttagcatgatgtaatacaaattaaatatttcattaattttatatcttctctaaagaatttggctaattcgacccatatctggagatgcagatggatcttatttaataggcagggaaggtacattgatataacattaatacttgactgtgtacaacttctcagggaagttacgcatttacttttaaccaagaagttggtttctctattgttgaaaagaaagaacatcaaaacagccaagatacctgctgtggaaatgtctctttcattggtctctgaaatctctattttacgctgactttcataagaagtatctagtcttccctactcggtcacctgggaagctgtgatgttaactgccaaagacccgtgtgacaaaaaaaaaaagaaaagaaaagaaaaatactgaaactaaaggacaagaagaggctccacatgaatcagcaagcagggtcagtgtgagtcccatcccaggtgtgccttgtgaatttgtaagaggaaatacagagccttgcaggtggcatttcccctggcaattagttttcaaaaggtcccctgcaaattctcagcaggaatgatgagcctatttccaaagccctttccaacaaccttcagatttccggcattcagattgcacttaaaaataacaatcaacttgccaatcttttttagcagccttctaaataggttgctgttcaaagaaataatgggagaggcagggtgagaaaacagcaggcacttgataaaggctactatgaatgagtgagtgaaatgaatgaatgtataagggcatgaatgaaaagcctacaaatgccattctaaatctgtaaatgatcagaaaagtatttttcctaagggaattatttcatctcaatttggaaatactagtttctggactcagagagtgcatataatctattttctcttacagttgatttgcatttataaaagtagggtgtttttttttttttttcagacaaagcacattataagaaaaagaaaaaaaactgataactttgttatgtcctcagtctaagcctttgaatctctttggttgaaatgagaaacctgttcctgctggctttcatccagtgttgcagcatttcaaggaagtttcagctgcattagacttgctctcaacccattaaaacccataaaacctagggggagttcagagggacccaaaataggaagaagaataggtcctcctctgctgctgtccaaacccatttcccacagtcagtatgatttacacaaagtcaatttgttttcttttttaccttttaaaaggaactttattttatattttattacctatatttaatgtgtaaaacatggtttttgaatatctgtatatatatatagtaagatgattactaccatcaaaaagattttcatatctatctcctctcatagttatcccttttttgtggttagtgatatggtttggctatgtccccacccaaacctcatcttgaattgtagctcccacaattcccatgtattgtgagagggagccagtgagaggtaattgaatcaagggggtgagtctttcccatgctattctcgtgatcatgaataagtctcatgagatctgatggtttgataaaggggagtttccctgcacaagctctcttctcttgtctgccaccatgtgagacgtgccttcagtttcagccatgattgtgaggcctccccagccacatggagtcatgaggccattaaacctccttcttttgtaaattgcccaatctcgggtatgtctttatcagcagtgtgaaaatggactaatatgctaaggatacctaaaatccaaaaaaaaatggcagataggaggcaggacaaaatgacagctcccactcacacagacagagcagtgtgtggagactcacatcataaacttttgctccaagaactactgcaggaatatatcaggaaagccaagagaatccatggatcctatgaaggaggcagattgctcccacagaacctgggagacagcacaaatactgtgaattcccaaactgtgaaagtgggaaagggggatcatccacccctgaacacacaccatcactgaaggtgcagatcacaggagaaggatttgaccttacctggagctaagataatttagagagctgagtgaaatacaggggtagaggaagaagcaggaaaagacctgtaggtactcttggtccccagggaagccatttctgacttgtctctcaggggtccttggggaaggctgccagaggaactgggaaaagaccacaaggagaaggaaacctccagctgaattgtgtaacaattccaagtgaacatgaagtttcctgaccagaacttgggagagggcatgaatatggtgtgcagactcgacaggcagggaggtgcgaaagccctgcttgctttctcagcttggaggctggtatcctggggcaagttctcagccctgcctacccactgcctggaaacaaactcggtgctgttaggggggtgtagggtgggaatgagaccagctttttaagttgcacgtgacctgggtgaggcttatactgcggcaagccaacccaaaaagagtctgagctcagccatgcctaaccctgcctccatttgatggttcttccctacccaccctggtagctaaagacaaagatcatattttcttgggagttctagggcccgacccacagtctgatcctccctatattaccacacctcatgctttcttgaaagtgccaattcctagcaggaggccatccagcataaaactagtgcaataaacaacaataatacaactaaggacactcacagagtccatttcactcctctgccacctccaccagagcaggtgctggaatccacggctgagagacctgaagaaagcaagacatcacaggactctgtgcagacacctcccagtaccagccggtagcctggtagcccactgagtggctagatctagaagagaaataatcactacagtaaggctctcagcaagccacatccctaggaaaaggttggggggagagtaaaacatcaagggagtaccccataagacaaaagaatctgaacagcagtcttgagctccagatctgtcctttgacatagcctacccaaatgagaaggaaccagagaaaattctggcaatatgacaaaacaaggttctttaatactcccccaaaatcacactagcttgccagcaacagatccaaaccaagaagaaatccctgaattgccagaaaaaagaattcaggtcaattattaagctactcaaggaggcaccagagaaaggtgaagtccaactgaaggaaatttaaaaaaatgatacaagaaatggggagaaatcttcagtgaaatagatagcataaataaaaaataatcacaagttcaggaaataaaggacacacttagagaaatgcaaaatatactgaaaagcctcagcaatagaatcaaaaaagcagaagaaagaacttcagagcttgaagacaaggttttcaaaataacccaatctacaaagacaaagagaaaagaatttttaaaatgaacaaagtctccaagatgtttgggattatgttaaacaaccaaacctaagaataattggtacccctgaggaagaagacacatcaaaaagtttggaaaacatatttgggggaataataaaggaaaacttccctggccttgctagaggcttagacatctaaatacaaacccaaggaacacctgggaaattcatcacaaaaagatcatcacctaggcacatagccatcaggttacctaaagtcaagagaaaggaaaaaatcttaagagctttgcagcaaaaacacgaggtaacctacaaaggaaaacctatcaggttaacagaaaccctacaagctagaagggattggggtcctatcttcagcctccttaaacaaaacaattattagccaagaattttgtatccagtgaaactaagcttcatcaatgaaggaaagatacatgctttttcagacaaacaaatgatgaaagaattcaccactaacaggccagcactacaggaactgctaaaagaagccctaaatcttgaaatgaatcctggaaatacatcaaaacagaaattatttaaagcataaatcgcacaggacctatgacatgctgtggctgtatcctcacccaaatctcatcttgaattcccatgtgttgtgggagggactcagtgggaggtaattgaatcatgggagcaagactttcccgtgatggttctcgtgatagcgagtaagtctcatgagatctgatggttttaaaaatggtagttttcctgcacaagctctctactcttgtctgcctccatgtgagatgtgcctttcactttccaccataatcgtgaggcctccccagcctcgtggaactgtaaatccattaagcctctttcatttgtaaattgcccagtctcaggtatgtctttatcagcagcatgaaaatggactaatacagtaaaatggtacccatagagtggagggctgctgaaaagatacctgaaaatgtgaaactgactttagaactggttaacaggcagaggttgaaacagtttggacagctcagaagaagacaggaaaatgtgggaaagtttggaactccctagcaatgtattgaatgactttgacaaaaatgcttataatgacatggataataaaatccaggctgagttggtctcagatggagataaggaacttgtgggggaactagagcaaaggtgactcttgttatgttttagcaaagagactggtggcattttaccactgccctagaaatttgtggaactgtgaacttgagagagatgatttagggtaggtgggggaagaaatttctaagcagcaaagcattcaagatgtgacttgggtgctgttaaaggcattcagtttcaaaagggaaacagagcataaattttggaaaatgtgcagcctggcaatgtgatagataagaaaataccatttgctgaggagaaattcaagctggctgcataaatttgcataaataacgaggagctgaatgttaatcatcaagacagtggagaaaatgtctccagggcatgtcagagacctttgcagcagcccctcccatcacaggcccaaaggtttaggaggaaaaagtggttttgtgggccaggttcagggtccctcttctgcatgcaatctagggacttggggccctgcatcccagttgctctagccatggctgaaaggggccaatgcaaagcttgggctgtagcttcagagggtgcaagccccaagtcttggcagcctccatgtagtgttgagcctgtgcatgcccagaagtcaagaattggggtttgagaacctcaatctagatttcagaggatgtatggaaatgcctggatgttcaggaagaagtttgctgcaggggcagagccttcatggagaacctctgctagggcagtgtggaagggaaatgtgggattggagcccccacacagagtccctactggggcactgtctagtggagctgtgagaagagggccaccgtcctccatatcccagaatggtagatccactgacagtttgcaccatgcccctcaaaaagccgcagacactcaatgccagtccatgaaagcagccaggaggtgggctataccctgcaaagccacaggggcagagctgctcaaggctgtgggaccccacttcatgcatcagcatgacctggctgtgagacatggagtcaaaggagatcattttggagctttaagatttgactgcctggctggattttggacttgtgtggggcctgtagcccctttgttttggccaatttctatgatttggaagagccttatttacccaatacctattcctccattgtatataggaagtaagtaacttcctatatggcctgtaatataaaaaggctcctaagtagaagggatttgccttatctcagatgagactttggactgtggacttttgagttaatgctgaaatgagctaaaagtttgggagactgttgggaaagcatgattgattttgaaatgtgaggacgtgagatttgggagggctccggacagaatgatatggtttggctatgtccccacccaaatctcatcttaaattcccatgtgttgtgggagggacctagtgggaggtaattgaatcatgggagcaggtctttcccatgatgttctcatgatagcaagtaagtctcatgaggtttgaaggttttcaacatgggagtttctgggccaggcatggtggctcacacctgtgatcccagcacttttggaggctgaggtaggtggatcacctgaggtcaggagtttgagactgcaacccgggaggcagaggttgcagtgagctgagatagtgccactgcactccagcctgggcaacaagagagaaactccatctgaaaaaaacaaaaacaaacaaaaaaatgcgagtttccctgcacaagccctcttctcttctcttgtctgccaccatgtgagatgtgcctttcaccttccgccatgattgtgaggcctccccagccacatggaactgtaagtccattaaacctctttcttttgtaaattgcccagtcttggatatgtctttatcagcagcatgaaaatggactaatacagactgtaaaataaaaatacaataaataaataaaaaccaaggtattcaggcaacaaatagcacaacgaatggattactacttacatctcaataataactttgaatgtaaatggcctaaatgctccacttaaaagatgcagaattgcagaatggataagaattcaccagccaagtatctgctgccttcaagatactcacctaacataaggactcacataaacttaaggtaaagggtggaaaaagacattccatgcaaattaacaccaaaagctatcaagagtagctattcttatatcagatgaaacaaactttaaagcaacagcagtttaaaaagacaaagagggacattatatagtgataaaaggccttgtccaacagggaaatatcaaaatcaaaatcctaaatatatatgcacctaacaatggagcttccaaatttataaaacaattagtactaaacctaaaaaatgagatagacagcaacacaacaatagtaggggacttcaatactccactgacagcactagacaggccatcaagacagaaagtcaacaaagaaacaatggatttaaactataccctagaacaaatggagttaacaacagatatttacagaacattgcactcagcaaccacagaatacacattctattcatcagcacatggaactttctccaagatagaccatatgctatggcacaaaacaagtctcaacaaatttaagaaaattgaaattataccaagtattttctcagacctcagtggaataaaattggaaatcaactccaaaaggaacctttaaaaccatgcaaatacatggaaattaaataaccttctcctgaatgatcactaggtcaacaatgacatcaagatgaaaatataaaaattctttaaactgaatgataatagtgatacaacctatcaaaacctttgggatacagctaaggtggtgctaagaggaaagttaatagcattaaatgcatatatcaaaaagtctgaaagagcacaaataaacatctagggtcacacctcaaggaactagagaaacaagaacaaaccaaactcaaacccagcagaagaaaagaaataaccaaggtaagagcagaactaaatggaattgaacaaaaaaatacaaaagataaatgaaacaaaatgctgcttctaagaaaagttaaataaaattgttagactattagcaagatttaccaagaaaagagagcagatcaaaataagctcaattagaaatgaaatgggagctgttacaactgaaaccacagaaatacaaaattttattcaagattactatgaacacctttacacacacaaactagaaaacccagaggagaaggataaattcctggaaatatacaaccctcctagcttaaatcaggaagaattagaaaccctgaacagatcaataacaagcagtgagattgaaatggtaattttaaaattaccaacaaaaataagtccaggaccagacggattcacagttgaattctatcagaactcaaagaagaattggtaccaatcctattggcactattccacaagaaagagaaagagggaatcctccctaaatcattctgtgaagccggtatcaccctaataccaaaatcatgacaggacatagcaaaaaaaagaaaactgcagaccaatatccctgatgaacatagatgcaaaaatccttaagaaaatactagctaaccaaaaccaacagcatatcaaaaagataatccaccatgatcaagtgggttttataccagggatacagggatggtttaacatacacaagtcaataaatgtcatacaccacaaaaacagaattaaaaacaaaaatcacatgatcatctgaatagatgcagaaaaagcatttgacaaaatacagcatccctttatgattaaaaccctcaccgaaatcaacatccaagggacatacctcaatgtaataaaagccatcaatgacaaacccacagccaacataatactgaaaggggaaaagttgaaaaaattccctctgagaactggaacgagacaaggatgcccactctcaccacttctattcaacatagtactggaagtcctagccagagcaatcagacaagataaagaaataaagggcatccaaattgataaagaggaagtcaaactgtcactgtttgctgatgatgtgattgtatattgtatacctagaaaacgctaaagactcctccaaaaagctcctagaactgataaatgaattcagcaaagtttcaggatacaaaatgtatgtacacaaatcagtagctccgctatacaccaacagcgtcaagccgagaatcaaatcaagaactcaaccctttttacaatagctgcaaaaaaataaaaacttaggaatatacctaaccaaggaggtgaaaaacctctacaaggaacactacaaaacactgctgaaagaaattgtagatgacacaaacaaatggaaaaacatcccatgctcatggatgggtagaaccaatgttgtgaaaatgaccatccttgtaagttggattcctaagtattttattctctttgaagcaattgtgaatgggagatcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacagtcatgtcgtctgccaacagggacaatctgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcacagatagctctcattattttgagataggtcccatcaatacctaatttattgagagtttttagcatgaagggttgttgaattttgtcaaaggccttttctgcatctattgagataatcatgtggtttttgtctttggttctgtttatatgctggattacatttattgatttgcatggagaactacaaaccactgctcaatgaaataaaagaggatagaaacaaatggaagaacattccatgcttatgggtaggaagaatcaatatcgtgaaaatggccatactgcccaaggtaatttatagattcaatgccatccccatcaagctaccaatgactttcttcacagaattggaaaaaactatgttaaagttcatatgaaaccaaaaaagagcctgcatcgccaagtcaatcctaagccaaaagaacaaagctggaggcatcaagctacctgacttcaaactatactatgaggctacagtcaccaaaacagcatggtactggtaccaaaacagagatatagatcaatggaacagaacagaggcctcagaagtaacaccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaacaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagtaaaagaaactaccatcagagtgaacaggcaacctaaaaaaatgggagaaaattttcgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaacaggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccagcccaaatgtccaacaatgatagactggattaagaaaatgtggcacatatacaccatggaatactatgcagccataaaaaatgatgagttcatgtcctttgtagggacatggatgaaattggaaatcgtcattctcagtaaactttcacaaggacaaaaaaccaaacaccacatgttctcactcatagatgggaattgaacaatgagaacacatggacacaggaaggggaacaacacactctggggactgttgtggggtggggggagcagggagggatagcattaggagatatccctaatgctaaatgacgagttaatgggtgcagcataccagcatggcacatgtatacatatgtaactaacctgcacattgtgcacatgtaccctaaaacttaaagtataataataaaaaaataaaaaataaaaaataataataaaaaaaagaaaagaaaatgaccatcctgccaaaagcaatctacaaattcaaggcagtttccatcaaaataccaccatcattcctcacagaactagaaaaaaaaaatcctaaaattcatatgaaaaaaaaggagcccgtgtagccaaagtaagacaaagcaaaaagaacaaatctggaggcatcacattacctgacttcaaactacactatgaggccatagtcaccaaaacagcatggtactggtataaatataggcacatagaccaatggaacagaatagggaacccagaagtaagcccaaatacctacaaccaactgatctttgacaaagcaaacaaaaacctaaagtggggaatggacatcctattcaacaaatggtgggataattggtaagccacatgtaggaaaatgaaactggattctcatctctcaccttatacaaaaatcaactcaagatgcatcaagaacttaagtctaagccctgaaactataaaacctctagaagataacatcagaaaaacccttctagacattggcttaggcaaagacatcatgatcaagaacccaaaagcaaatgcaacaaaaacaaagataaataggtgagacttaattaaactaaagagcttctgcacggcaaaaggaaaagtcagcagagtaaacaaagagtgggagaaaattttcacagtctatacatctgacaaaggcctaatatccagaatctacaaggaacttaaattagcaagaaaaatgaaacaatcccatcaaaaagtgggctaaggaaatgaagagacaattctcaaaagaagatacacaaatggccaacaaacgtatgaaaaaatgctcaacatcactaatgattagggaaatgcaaatcaaaaccacaatgcaatatcaacttacccctgcaagaatggccataatcaaaaaatcaaaaaataatagttggtggtgtggatgcagtgaacaggaagcacttttacactgctggtgggaatgtaagctggtacaaccactacggaaaaaaggggagattccttaaagaactaaaagtagaactaccatttgatccagcaatcccactacttggtatctacccagaggaaaagaagtaattatacaaaaaagatacttgcacatgcatgtttatagcagcacaactcacaattgcaaaaatatgaaacaagcccaaatgcccatcaatcaacaagtggaaaaagaaattatggtgtgtgtgtgtgtgtgtatgtgtatatgtatatatatatatatatatatatatatatatatatatatatatatataatggaatactactcagctataaaaaggaacaaattaaagccattcacagcaacctagatagaactggagaataatatttcaggtgaaataactcaggaatggaaaactaaacatcatatcttctcactcataagtgggagctaagctatgaggatgcaaaggcataagaatgatacaatggacttcggggacttgagggaaaaggtggaaagtaagtgagggataaaagactacaaattgagttcagtatatacagcttgggtgatgggtgcaccaaaatctcataaatcatggctaaagaatttactcatgtaaccaaataccacctgttctccaaaaacttatgaaaataaaaaaaatgaagaaaaagaatatcaaaaacctattatcttaacaaatttctaccatacaatacaatattattaagtatacatctcatgctgcatatatgatctctagacttatccatcctacctaatggaaaatttgggccctttgatgtatatcttcctacttcctctccctccctggtcttgataaccaccattctactctttgtttctatttatgcaatttttttagattctacataccaatatttttcttcactgagcaatgggcttgctcttccaataaattatactctaatatatagaattccctaaataatcagctttaatttcttcaaaacaaaatgaggagtttcataagatgaccttggaagtcttcttttataaatatttttaatgaacttgatagactattttaagaaaaaaataaaatagtgcctaaaaattaattttcatttataactttggaaagaaaactgaaaataattatgcactctaatatgactgtcttgaaaaaggattcgtgttaacaactgagtagagtatattgcaactaacaccataaaaagcaatcctggaaaacaacatatgatgaacgattccattgaaaactaatgaaaatatggcaaacctaaacttgttaaggtgataaatacctgacatgcagggcataaagaaacattgcttgtaaaataaaacttcccaagtaaaggggaacaaaaaatatcacaggtggtttgtgataaatgtagacacattcccacatgtatgaaatgtgaaccaaaaagaaggttaatagcagcttccattcatataagaaaaaagaacaagtcagcatttaagcttaaagaacaccccaattaaagatacagttgaaaaacaaatgtatccatgaagggaaaataaggcccttaaggaagaggaattggaagaaagggccaaggcaagaggatgaaagtgctcggcgctggtcccaggtaaagttatgactctgggcaggtggtctgaggattgcccatttgcagctccatacccatttccctctgacatctctccctgcccactcaggctcctgctgtctccctagcaaaaccctgcttttgggtgaaaacctctatatcatgctcaccacagtacaaagactaatccagctccatgggacccctgggtgtggctggggctaagcaggggagaaggggaagaagatgatgtgcctcttagcgaaggtcacacaaggttggggcaggatgcctcccctctcttcctagatctgagtgggtctgtgcctggcaatggccaatctctgaaaaaaaatgtactgttgagaacaaacgccaattttctggctacgctaacaagagctaagtgacgcagtggacaaagcaatgatgctgttcctggctcaatctctctcttcgacaatgataatttgccacatcaacttaccttcccagacacgaagcatcagaggattagctattaaaagaaagacattttctcgctcattacagcctgcaatgtaaaatgtccagagatacaaggagtcctgttttcaccattaaagtagaaattatttccggcagctttgggagaaaatgcaattattttccttcctgtcacagtgtttccaaactcacctagagatgagagcaccctattaaaatggactcattgttcgaatgatgccagtgaatgctcttctctgacctgggggtgggagactggcccctgagtcctcaccccttgggattcaggatcaccaagggcacaggtaattagacagtactgagtcactaccacttacattctagtagcaggaagaggaaacttttcttttttagagtgctctttttattatccttgtgagaaagtacatatagtgatctgaagtgcaagagtgacttgtgcagaatctcctataagcagcgagaaaaccagtgtgaagtcctacctcttgacaccaagtctagcgttaacattaccctctgacctgcattaatacgatatgttatagagagaccagattcccgcttcctatgtaattcgtagagtcatcccagtctgcttagcaaaggaagtcatagcacaggggtgccgttgccccggaagcattgcaatcaatcatcagtttgggattgttttctttcacttccaccaacagcttctcgatttccaaattagttccataggtcttcaactgtaggtgttttagattacagtttgggttctctaacgccttaaagagaatccgtaatccacgagccatgtgattgagactcaggtccaagtttgtgaggacttcttggagtagctttgagagatgtctgcagccacgcttggtgatattgcattgctgtaacaccaacgtctgcagtttacactcagggtaactcaaaccctcacccagaagcttcacccctttatccccagtggggttcttggccaagcacagttgtgtcagctgctggctgacaaccaaaacagcagcaaggtccttgcaactggcttctataagatgacagttttccaacgacaacttctgcaagatgctatttgggtgtctcactgtctcctacagcaacttggcaccctcatccaggacctcattggctgagaggtgtaggtacctcagggactggtgggtcttgagtgcaaaggggaaatcagcccactgccccatggtggaagaggaaatttttcaaggaagaaagtgaacactttagggagagcccacccattttgctaatggccagagctcactttgccagattgctgcagactttttggctgctctattcctagaagtccagtggctccctgccccttgtgaaacctcacagtttgaatctgcttagccacgggtctttccccacttgcctgttgccacagcgaaagaaagacacctgtaactccatctgcactgatactgagttctttggctttgggcagagctctcaaccaacttggctgttaagcaaagttgctccaagtggcaggttgcttccctgcagggtccactagactttgctctggtcactgggctggtcacagtcttagtccctgacccaggtcgtcttgttctctgttcctaagaggacccagtgagatcatgtccctatctcagtacaatctcctcctcagaaattcagagtcaacattctgaagatgactaattcacaccatctggcatcatgagctatcatatcaccatccaagatgaatttccagaataaatgactaaggagagcccccctgccaaccgccaccacctcacacaccttcaaactatgtttttactttagtattgcttgtatagtgcaatgagaatccactgttatgatataagcattccatgatgtatcctgatttatatttttaagatatcatttttgtatgtcatggatattgtttttaatgtgtatgctgatacgtgttttctttgctttttggttgtgttatgtgccataggctacacgacatcttgggcaagcccaaaaattgaagcagaagttaacagtaaaggaatgacttctgattccctcatcatgtctacctaggtcctctaaagcagtcattcaataggtacataaaaattatactcttgacaacactttgaggtatactcagtctcaaaatttttaaggtaggtttccaaggaccaattcctccccaaagagcaactgtgggctaagctgtgggaagcctagaagggcagaaggctttgtgaaaatattcctttaacactagcactattcgaattctcagctttgggctaatcatgtgataggaaatatgagcctaaggctaaatcattgaactgagaaccttacagtggggctaacatgacccttggactgtggtattcactagctaccaatggtagcagaagcaaataagaaaataaatatttggagcacaaaattctcacaaaataagatgataaaatgagtttacaattaaatatcactaagtgtaagaaaaggacacaataagtaagaataaggaaaagcatcaaacattggatttaaattcacaaggatttaagatattacaagtgttgtccaatgtttgctactgttgaggacagttaaactaacaagagactttacaacagatataatgaaagacagaggatgtcaaatgttgtgagaacacaattgtcaacctcaaattgtatagtcaacagttatttaaagaatacaaaagtaaaataagaatacttacagataaataaaaactgtaagagtttaccgctaagaagacccaaatgaacttctaaataatatgttacaggaagaacaattattttagaaggaatgtctgggatgcaagaagtaatggtgataaaataaaatgttagcagtatgtgcaaatacaagcaagcattatctttacaaatgataacaagtagtactatttcatgggattacaaaaaaatcagaaataaaatactggtcaataatagtgaataagctgtagaataggtaagcagagttaaagtttattgtttaggagaataattaagatttttaatgtaagattttgttaaagtaaataagcatgggaaaatttcaaagtaacagtaaattgatgagaatagacttataacttccaaacaaatggaaataataaaaatggaataagggaaaacatgaatacccagtgttatagtttggatgtttgacccttctgaatctcatgttgaaatttgatccccaatgttagatgtggggcctaatgagaagtattcaaatcataggggtgtatccctcatgagtagatcagtgccctccttggaggtggcaggaattagtgagttcttgctctattatttccctggagagttggtcattcaaaaagatcctggaatctccctcccctctcaatcttgcttcctgcctcaccatgtgatctctacacacactgactcttcttcaccttctggcatgagtggtagcagattaaagccctcaccacaagcagatgctggtgctgtgcttcttgcacggtctgcagagctgtaagccaaataaacctcttttctttataaattatccagcctcagatattctttttatagcaacacaaatggactaagacatagagaaacatttaataaagacacacacatagcagtaagaaacaagaaaatatgaaaagtaaaacaaattgaagtaaaaaagtgagattgtataaacaagtccaaacatatcaataattacaaaaaactttacatagatcaaaattgtcacctaatagagattttcacactggatacaaagaccaataaaacccagatatatgtagttgcaagtcacacacctaacgcatgagggcatggggttgaaggtaaaatggtgagaaaagatagaccaggcaaatactaaccaaaataaaacatatatctatattactatttgaaaaccaaagcttaagacaagtgaaaatcatcactagagaaataaaaggttgctacataaaaaaacatttagtctaccagtgcagtaaacaatgctgaggttttcaaaacaaattagcttcaaaatgtataaagcaaagtgtatagatttacaggagacattaataatcctgacattttactggtgagatttcaacacaacttttcttgattatttacaggtcatttagataagaattaatcattaatgatttgtaaactgcaattaataagctataatgtacataaattgaattctgcacccaacaattagagaataccaattatcctcataaatacatggagtatttacaaatatagattataataaagggtaaaagaagtcaagttttcagagaactggaaactgactaaaacataattaagttagatgtcaataataaaaagacaaattttttagttcctatacatttagaaatgtagaagcaaaaccttaaccaatggattgaagaagaaataacaatagaactttttttttattattattattatactttaagttttagggtacatgtgcacaacgtgcaggttagttacatatgtatacatgtgccatgttggtgtgctgcacccattaactcatcatttagcattaggtatatctcctaatgctatccctcccccctccccccaccccacaacagtccccagtgtgtgatgttccccttcctgtgtccatgtgttctcattgttcaattcccacctatgagtgagaacatgcggtgtttggttttttgtccttgagatagtttgctgagaatgatggtttccagcttcaaccatgtccctacgaaggacatgaactcatcattttttatggctgcatagtattccatggtgtatatgtgccacattttcttaatccagtctatcattgatggacatttgggttggttccaagtctttgctattgtgaatagtgccacaataaacatacgtgtgcatgtgtctttatagcggcatggtttataatcctttgggcatatacccagcagtggggtggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagatggtatctcattgtggttttgatttgcatttctctgatggccagtgatgatgagcattttttcatgtgtctgttggctgcataaatgtcttcttttgagaagtgtctgttcatatcctttgcccactttttgatggggttgtttgtttttttcttgtaaatttgtttgagttctttgtagattctggatattagccctttgtcagatgagcagattgcaaaaattttctcccattctgtaggttgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtaatgtctaggttttcttctagggtgtttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttcctgtggtctatatctctgttttggtaccagtaccatgctgttttggttactgtagccttgtagtatagtttgaagtcaggtagcttgatgcctccagctttgttcttttggcttaggattgacttggcaatgtgggctcttttttggttccatatgaactttaaagtagttttttccaattctgtgaagaaagtcattggtagcttgatggggatagcacatcactggacaatagaacttttaaaatacttagaactagattattttttaaatgctttgtataacaatccttagatgtagataaactagtacttagaaggaaaattactgccttctaatatttattgaaatactaatttatctcaatattaatgtgctaagtatccaatttaagaaacttggatatagaacaaccaaaaatacacaacaaaaagaagatgtagcttttcatatgtcaattatacctcaataatgttgttttttaaaaaggtaggagataaggataagaataacaatcaatgaaacagaaaacaaagagacaaaaggagagatatacaaaaccaaagactgcttttttgggaagattaacaaaattggcaaatctttggtaaaacttattaaaagcaaaacggatggcaaaaactataattctagcaatgaaaagtggatcatcattacagatacagcacagattagagtataaggtactactatgaacaaatttatgtcaaaaattaaaatctagacagacaaatttctggtcacatgtaaattaccaaaacgtattagaatatacagtcttagtaattgtatgagtccactctcatgctactatgaagaacttcccaagactgagtaatttataaaggaaagaggattaattgactcatggttctgcagggctggggaggcctcaggaatcatggcagaaggcatctcttcatagggcggcaggagagaaaatgagtgcccagcaaagggggaagcccttataaaaccatcagatctcgtgagaactaactcactatcaggagaacaggatgggctaaaccacccccatgattcaattatctccaactggtccctcccacaacatgtggggattatgggatgtacaattcaagatgagatttggttgaggacacagccaaaccatatcagtaatccaataactattagcaaaattgaagcagtgattaagaactttcccaaaaaagaaatacaagaccaaaatgattttgctagtgttttctctcaacatatcaaagaccagattatttccatattaaataaccgttctaaaaaataaaataggaaatactagctaaatcattctatgaaattattaaaagcaatggcaaaaagcaattacttttgcaccaacctaatattgtaatcttgctatccaatccagaaaaagacaatatgagaggagaaaccatagtttattctcactcgtgacccagatgtaaaaaattctaaaactaaaaaaataaataattgaattcaacaatatataaaaataaatagacagtgaccaggctggatttatccctagaagtcaagcatgattgaccttagaaaatgagtaaatattattatattaatgttttactaacaagaaaaaatgtaatagccttactagacacaaaaaaacacatttggtaaaattcaatgccaatgtataatataaatttttagcaaattaggattagaaggaaaattccataatccaataaaatgtatctagcaaaaccctgatcaaacattatatttaacaggaggacattaaaattattccttttactatcaaaaattttaaaatgatgctatcactaactttattcaacactttcctagaagtcttggtattttcagtaggacaagaaaaagaaattaaaggcatatgaatgcaaaatgaaaaaaacaaaaatgttattattcacagattatatgattgcccatataggaaattgaaacaactatacataaaaattcttagaagtaataatttagcaaactgaatagctataatatgagctttaatatatctattgcatttctatacacccagcaacatgtaaaaaatataattttgttttagacagtttctcgctctgctgtcacctaggctgaagtgcagtggtgatcatagctcattgcagcctcaaattcctgggctgaagtgatcttcttactttatttatttatttatttatttatttatttatttatttatttattggagagacaaggtctctctatgttgccaaggctggaaaaaatgtaagtttacaaagacaccatttaaaatagaaggaaactataaggtaactaagactaaatattgcaaaaaatgtgtaagatctgtaagtagaaaattataacatttatagtgagatattaaaacaaatagttggagtgggtcatttataaaagaaacttaatatccaaaggatatgaattcttcttgattcataaatccaataaatttccatcagaattctaaaatgattttttaggaatttgatgaggtacttctaaattttatatggaagtacaaaaggatgaaaatagccaagaaacatctgaagaacgtggaaaattgaccatcccaaatagcaaagtattttataaaatcatattaattaaagcagagtgttattgatgcagtgatatacaacatggataggaacagacacatacaaatatagaacttttatgtgtaacatagggggcatatatcacatgtagacatctacaggaaatggctgggcactgtggctcagatctgtaatctcagcactttgggagaccgatgcaggtggatcacttgaagtcaggagttcaaaatcagcccggccaacatggtgaaaccctgtctccactaaaaacacaaaaattagcctggtatggtggcgtgtgcctgtaatcccagctactcgggaggctgaggcaggagaatcgcttgtacatagggggtggaggttgcagtgagcccagattgcgccactgcactccagtctgggcagcagagtaaaactccgtctcaaaaaaaaaaagaaagaaagaaagaaaagaaaagaaaagaaaagaaaagaaaagaaaagaaaagaaaagaaatctataggaaaataaaactggatctttctcatgatacctaaaatgcagaaaagtaaagatcataaaattttaaataaaatataaaagaatatctttctgatacagaggtagaaataatttatttaacacaacacaaaaaatagccatctaataatatattaacacaggcagctatattaaaagtaagaacttcagtttagatacaaacaccaagacaaactacaactggagagaagatattcatgacgcatccaaccaatacaacatttgtattgaaaatacacaaaaaaatccacatattaataagaaaaagacaaacaacccaatacaggttgaacattcctaataccaaaatccaaaatccaaaacttttatagtgccaacatgatgccacaggtggaaaattccacacctgacacctttaccttctgatggttcaatgtacacaaactgtttcatgcacaaaattatttaaaatattatataatattaccctcagctatgtgtataaggtgtatataaaacataaataaattgtgtttacacttgggtcctacccccaagatatttcagtatgtatatgcaaatatttccaaatccaaagaaatccaaaatcccaaacatttttagccccaagaatttcagataagggatactcaatctatcataaatggataaagaatttgaagaggcttttcatagaaaagaaaactaaattgccaaaaatatataaaattatgctcaaattttagatatataaagtgattaggggaatgaaaattgtgattacaatgacattgttttaaaaccaaaactttagaaatctgagaataccaagtgttagtatgcataccacagagaaactcttgcacatctgcaccaggaaacatgtacaggcactgtttataatatcaaaactctgcaacttagacatctgaattagtcagagttctctagaggaacaagaactaataggatggatgtatacataaagcagagtttagtaaggagtattgactcacatgatcacaaggtgaggtcccacaataggccgtctgcaagctgaggagcaaggaagccagtcagagtccccatacctcaaaagcagagaaactggtagtgcagccttcagtctgtggtcgaaggtccaagagtcccaaagctgaagaagctggagtctaatgtttccgggcaggaagcatccagcacagaagaaagatgtaggctggaagactaagccagtctggtctttccacgttcttctgcctgcttttattctggccacggtggcagctgattagattgtgcccacacagattgagggtgggtctgcctttccaagtccactgattcaaacgttaatctcctttggcaacaccctcacagactcacccaggaacaatattttgcatccttcaatccaatcaacttgacactcaatattaaccatcacaacatctattagcagaaaatggataaatacgttgtataatcatataacaagttactatgcaacagcaaaaatgagaatgaacaatgttaagtgagaaaagtctcagaaaactgtatacagtatgataccaatcttagaaagcttagaaaagagtaaaagtaaataatatactatttagacatacatatacaatgtgataaaactgaatttcaaaaagcaaggaggatgataatataatctgaatagtgaaaaagtgaattatcatattcactttccaaactaccaggggcaaaatcttttactttctcagacagtaaagttatttgactgcctgctttacctgcaagtaccataacctcaggcacctggacacataattataagaaaagatgtgttgatgctatcattcttgatgaaatgcactgaaaatgtcatgttcccattcctccttaagtaagaaacaaaaccgacattgctatgacacctaacaacttaatacaaggtaaaaaatcaaacaatcaggtactattctgttgtttaccagaattatcaaacagctaagagtggtgtgactactttttatttttatttttattttttttggtcagatggatacagccagacacatttcagtgactcttgaaatgataataaaaataatttaagcaaatatcaaccagctttctcatttaactgcatatttaaagtaaaagtgttcatgttaattgaatagatttgagaaatgtctccaaatccccacatcattttttcaaaaattctgatcaaccaagttgccttcctgttgtgcaaatgtgtttttctcatttttctcccacttatttatttgcttaaatggttcggttctcaacaggcatacaagttacatgaacaatgtaccataaccaccaggtggaaaatgaaaaattcatcccgagcatgtatatgaccccatgtggaacaaatttgcctcacattgacattcatttattcaacatttaaatatatttaatgaatacactccattccagggattgtgctttgaatacagtggtgaattcagtttcattgaggagatcatcacatgactacatcattaaaatataacatgtgatatatatataatgctagagatatgcatggtatattttaataaatagggcaaaaaggatatctaacccagttgtcaagaaaaagtagccacggaagccatgtttgaattggtggtgcctaaattgaaacttagttgggaggagccaagatggccgaataggaagtcaaattgtccctgtttgcagacgacatgattgtatatctagaaaaccccattgtctcagcccaaaatctccttaagctgataagcaacttcagcaaactctcaggatacaaaatcaatgtacaaaaatcacaagcattcttatacaccaacaaaagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatggataggaagaatcaatatcatgaaaatggccatactgcccaaggtaatttacagattcaatgccatccccataaagctaccaatgactttcttcacagaattggaaaaaactactttaaagttcatatggaaccaaaaaagagcccacatcgccaaggcaatcctaagccaaaagaacaaagctggaggcatcacactacctgacttcaaactatactacaaggctacagtaaccaaaacagcatggtactggtaccaaaacagagatatagatcaatgaaacagaacagagccctcagaaataatgccacatatctacaactatctgatctttgacaaacctgagaaaaacaagcaatggggaaaagattccctatttaataaatggtgctgggaaaactggctagccatatgtagaaagctgaaactggatcccttccttacaccttatacaaaaatcaattcaagatggattaaagacttaaacgttagacctaaaaccataaacaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttagcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcacagaaatgcaaatcaaaaccacaatgagataccatctcacaccagttagaatggcaatcattaaaaagtcaggaaacaacaggtgctggagaggatgtggagaaataggaacacttttaccctgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaggaacaaaaaaccaaacaccacatattctcactcataggtgggaattgaacaatgagatcacatggacacaggaaggggaatatcacactctggggactgtggtggggtggggggaggggggacggatagcattgggagatatacctaatgctagatgacgagttagtgggtgcagcgcaccagcatggcacatgtatacatatgtaactaacctgcacaatgtgcacatgtaccctgaaacttaaagtataataaaaaaaaaaaaaagaaacttagtttagtgtgttggtcgtgcgagggagaaacagcatgagagaacacattacagtgagaaaccatatgatgtgtttcatatggggtgatattccattcattattattggagttccaagtgtaacacactgagcagtaaaagtggtgtgtgcggaaacatctcctggagagtcttgtcagtaatattgaggaattcggactttattccgctaatgttatgaatcgtattaatagatttcttaacattgagccatcattgctttctgggaatgagctccatttgtgctgctttattctatttgctaaaattttatttagggtatttgagtcaatattcatgagtaaaattgatctgttggcttttaaaaaaataatatatttgtcaggttttggtattggtgatattttgcctttgtaagacattgaaaactgtcctttcccatctgtgtcagtggttctcaaacttttatgcacataagaatgacttgagaagcttgataaaaatgcacattcccagacctcacattcacaggctataatttgacaattctggattacaaaagcaaatttgagcacctcaggtgctcctgaatcagataatttaggagcagacttttttgagaaacaatgtaatatgctctaggccagtgtaaatagcattggagttactcttcttaaaatgtttcatggaatacattcataaaaacactcagacgtttcaagaggtgaactcttcaacaactaaaatttttttctatataacttttctgtctagatttcctatgtcttctgggcttaatttttttaatgtatattctccaagaaaataatccattgcattcaggttttcaaatgtaaacacaagctaagagttgtgctaagcattattataattttgatttcatcaatatctgcagctatttcttcattctagttcctaattttgtctgattttactactgttagtttctggacattataagattttggttttttgtctttcttacaagatgttgaagaagtttattttttcaactttaataaacatttataatgtagtttaacatattacagaaaaaattagactcataagcatacatttggtaaattttcacaaagggaatacactcattaacccatactacatcaagaaatagaacattaagcatatcctagaagtccctgtgtgttttttcctaatcagtatattgtctctccagaggcaaccactgtcctgacccccaacaccatacatgtatctactcttttgtgtctggcttctttcattcaacattatgattttgaggctcatccacatctttgtatacagcagtgtttcaatttccagtgctatatgttatattgtatgaaatacactttatatttaatatccaattgaatatttttgtagttttattaatttttggttttatcattctctaatttgaatatgatctaaattatttctgttttaaatttactaagctttttttaaattgagttattgcaaatttaccatagtgaaatgaaaagaagctatatactatttacaatggcaaagtcatggaaccaacccaaatgcccatcaatgatagactggataaagaaaatgtggtacatatacactacggaatactacaaagccataaaaaggaattagattatatcctttgcagagacatggatgaagctggaaggtatcatcctcagcaaactaacacaggaacagaaaaccaaacaccacatgttctcactcataagtgggagttgaacaatgagaacacatggatacagggaggggaacgacacacaccagggcctgttgtgggattggggggcaaggggagggaacttagaggatgggtcaataggtgcagcaaaccaccatggcacatgtatacctatataacaatcctgcacgttgtgcacatgtatcctggaacttaaagtaaaataaaataaaatttaaaaagaaaggaagctatattttctgttttcagggtacatagttcaatgcttattttattaatgtacctttaaaattttgaagttttataggtcacctgtattcttttttaaaataacttttaagttcagggatagcaggtttgttacataggtaaactgcatgccacgggggtttggtgtacagattatttagtcacccaggtaataagtatactaccagatagatattttttcctgatactctctctccttccaccctccaccctcaagtaggccctggtgtctgtcattcccctctttgtgtacatgtgttctcattgcttagctcccacctataagtgagaacaaccggtatttggtattctgtttctgagttaagttgcttaggataatggcctctacctccatttatgttgctgaaaaggacaagatctcattcttttttatgtctgtgcagtattccatggtatatatgtaccacattttccttattcagtttatcgttgatgggcatttaggttgcttccatgtctttgctattgcaaatagtgctgcaatgaacatacacatgcatgtctttatggtagagcaatttataatgttttgggtatacacccaataatgtgattgctggatcgaatggtagttctgtttcaagtttttggagaaattgctataccgttttccacaatggctgaacagttccactagcagtttataaatgtgttccttttcctctgcaacttgatttgacatttctgatttggctctcagtttggatgctgttggtatacaggagtgctagtgtttttgtacattgattttctatcctaaaacattgctaaagttgtttatcagatcaaggagctttagagcctggaatatggggttttctagatatagaatcatgttgtctgcaaacagggatagtttgacttcctgtcttcctatttggatatgtttttttttcttttatttttatttttatttttttttccttgagacagagtcttgctctgttgctcaagctggagcgcagtggtgcgatctcaactcactgcaacctccacctcctaggttcaagcaattctcctgcctcagccttccaagtagctgggattacaggcacatgccaccatgcccagctaatttttgtatttttactatagacaggattttgtcatgttggctaggctggtctggaactcctgacaccaggtgatctacccaccttggcctcccaaagtgctgtaaaagtggtgtgtataatcccaatgaatgggattacaggtgtgagccaccacacccggccttttatttctttctcttgtctgattgttctggccaggatttccgctactatattgaatagaagtggtgatagagcacatccctgtcttgctccggttttcaaggggaatgcatccagcttttgcccattcagtatgatgttggctgtgggtttgtcatagacggctcttattattttaaagtacgttgcttcaatgcctactttattgagggttttttaaaacgaagagatgttgaattttatcaaaagccttttctgcatctattgagatgatcatgaggtttttgtttttagttctgtttatatgatgaatcacatttattggtttgtgtatgttgaaccaatcttgtatcccaaggataaagactgtttgattgtggtggattagctttttgatgtgtggctggattctatttgctagcacttttgcatctatgttcatcaagaatattggcctgaagttttcttttctgggtgtctctgccaggttttggtatcagcatgatgctgtcctcgtagaatgagacgacccctcaattttaaggaatagtttcagtagcaatggtatcagctcttctttatacatctgtaagaattcagctatgaatccatctagtcctaggtttttgggattggtaggctttttactactgattcaattttggaactcgttattactctgttcagggtttcaatgtcttcctggttcagtcttgggaggttatatgagtctaggaatttatcgatttattctagattttttagtttgtgtgcatagaggtgtcacaatagtctcaggattttttgtatttcagtggagtaagtggtaacatctcctttgtcatttctaattgtgtttatttggatcttccctcattttctttgttagtctacctagtggtctatgcatcttactagtattttcaaaaaaagtcaactcctggattcgttgaccttttgtattttttgtgtgtgtgtgtgcttcaatttccttcagtccagttcagtttttggttactttcttgtcttctgctagttttagggttggtttcttcttgcttctctacttcctctagttgtgtgttaggtttttaatttagatctttctaactttttgatgtgggtgtttagtactgttaacttccctcttaacactgctttagctgtgtcccagatattctggcatgttgtatctttgttctcattagtttcaaagaacttcttgacttctgtcttaatttcattatttagccaaaactcattaggagcaggttgtttaatttccatgtaactgcatgatgttgagtgattttcatatcattgatttctatttttattgcactgttgtcctagagtgtgtttggtatgttttcagttttttaaaatttgatgttgaaggttttatgtccaattgtgtggtcaattttagcatatgtgccatgaggtgatgaggagaatgtatattctgttgttttggggttgagagttctgtagatgtctgttaaggccatgtggtcaagtgttgagttcaggtcctgaatatattttgtaaattttctgccttgatgatctaacactgttagtggggtgttaaagtctcccactattattgtgtgggaacctaagtctctttgtaagtttctaagaacttgttttatgaatctgggtgctgtgttggatgcatatatatttgggatagttaggacttcttgttgaattgaaccttttaccattatacaatgtccttctttgttttttattttttatctttcttggcttaaagtctgttttgtttgaaattgggatgacaatcccttttttctgttttccatttgcttggtagatatttattcatccctttattttgaacgtgtgactggcactgcacatgagatgggtctcttaaagatagtatatcattgggtcttgctttatccagcttgccactctgaacttttaattggggcatttagtccatttacattcaaggtcagtattgatatgtgtggatttgatcctgtcattgtgttgttagctggttattatgaagacttgtttgtgtcattactttatagtgacactgctctgtgtacttaagtgtgtttttatattggctggtaatagtctttcctttccatatttatcacgcctttcaggacctcttataaggcaggcttggtggtaataaactcccttagcatttgcttgtctgaaaagcttcacttatgaagcttggtttggctggatacgaaattcttggttggaaattcttttgtttaagaatgctgaatataggctcccagtgacttctggcttgtaggatttcttctgaaagatccactattagcctgatgggggtccctttgtagatgacctgccccatctctatagctgtctttaacatgttttgttttgtttttttccatttcgaccttggaaaatctgatgattatatgtcttgggagtggatttcttctgtagtatctcacaaaggttctctgcatttcttgaattttaatgttggcctccttagtgaggttggggaggttttcatggaccatatcctgaaatatgtttccaagttgcttgttttctccatgtctctttcagggacacaaatgagtcataaatttggtcccttacataatcccatatttcttggaggtttcgttcattcttttttattcttttttctgtatttttgtctgactgagttatttcagagagccagttttaaagttctgagattctttcctcagctcagtctattctgttgttagtactagcaattgcattataaaattcttgtagtgtgtttttcagctatattagatcagtttggttcttttttataatggctatttcttctatcagctcctgtgttgctttgttgtaatccttagattccttggattgggtgtcaactttctgctgaatcttgatgatctttattcctatccatattctcaattctatttctgtcatttcagccattttggccctgttaagaacccttgctggggaattagcctggttgtttagaggaaagaggccactctggtttttaagttcccagagttcttgctgtggttctttctcatctgtgtgggcctgtgttcctttaactgtggtgtaatttgagtacagacagtagacttcttttctggacgttttcagagtgtcaaggctttgtgcagggtctttatttatagctgaattgttgtccttgatttcacaaggggggtatattagcaaataatttttggtgttgaagtttggcctttaatccatcttgaattaatttttgtataaggtgtaaggaagggatccactttcagctttctacatatggctagccagttttcccagcaccatttattaaatagggaatcctttccccattgcttgtttttctcaggtttgtcaaagatcagatagttgtagatatgtggcattatttctgagggctctgttctgttccattggtctatatctctgttttggtaccagtactatgctgttttggttactgtagctttgtagtatagtatgaaatcaggtagcgtgatgtctccagctttgttcttttggcttaagattgagttggcaatgtgggctcttttttggttccatatgaactttaaagtagttttttccaattcttcaagaaagtcatcggtagcttgattaggatggcattgaatctataaattactttgggcagtatggccattttcacgatattgattcttcctacccatgagcatggaatgatcttccatttgtttgtatcctcttttatttcattgagcagtggtttgtagttctccttgaagaggtccttcttcctcagggatctagaactagaaataccatttgacccagccatcccattactgggtatatatccaaaggattataaatcatgctgctataaagacatgtgcacacatatgtttattgcggcactactcacaatagcaaagacttggaaccaactcaaatgtccaacaatgatagactggattaagaaaatgtggcacatatacaccatggaatactatgcagccataaaaaatgatgagttcatgtcctttctagggacatggatgaagctggaaaccatcattctcagcaaactatcacaaggacaaaaaaccaaacaccacatgttctcactcataggtgggaattgaacaatgagaacacgtggacacaggaaggggaacatcacacactggggcctgttgtggggtggggggaggggggagggatagcattaggagatatacctaatgttaaatgacaagttactgggtgcagcacaccaacatggcacatgtatacatatgtaacaaacctgcaagttgtgcacatgtaccctaaaacttaaaagtataataaaaaaaaaaaaagttttggcctgtgatccaataggtggtgcttaagaaaaacagtctgtcggtaggctcttgctcagccaagtggctcctctgtatttcctcatgattgcagctggactccctctccgtgctctgaaagtgtgtgctcctctcccacttgagtgctggctgcagatctcagcttgacactcccaggttgcacaccacagctctggggtgagctcaggctttatgctctctccccaccttggaggcagcaggggaaggggccttagcagtggttgtggcagagggcctttcacttgtctcttggggtttcgccccagagacatgtggagctaccatcaattggtgcaatgggcccaggatggggtggctgcactgtgggcccaagctggggggtagaggaggtgagggggcctgcctggtaacaagcgggcggtgcatgtgggtaacaagggagacaaactggcctcttctcttgagaggaactgcagcttgctggaggtgtggttaaagcacttagggtctttgctccttacccagtccgagggcagcaagggcagtaccactgcagtggcaaaagcccagaggggcttttggttgcctctgggagctccacctcagggaaatgcagattgttcagccagggggtggggcgactgcactgttggcctgagctggggccccacttgttgaggagcacggggtcaagggctcacagggagtagagactgaactcctctccatatggtgactgtggcctattgggaggttgggtgaaactctcaggctctttgtttcttccccagactgaggacaacaggggcagaaccattgctgtggtagtagcagacgggctgtccgttacttctgggagcccctccccggggaaactcagagccactagcagtgggtgtgctcagctgtgggtgaggcagttgatctgtgatcctgaccaggggccctgcctggtgaagagtgaggggtgggggctcacaaggaaaggagactggattcctctccatatggtggctgcagtgtgctgaaagagccagcatagtgactaaacctgttgttccttccctagcctgagagtggttatggcagtaccaccgcagctgcaatggcagaggggttgtggttttttctgggatttcttctttatagaactgcagagctacctccaattaaagcgttcaggtgaaggcagtgtagttgtgctggagtctcaggttgcaagggctcgcctagtaaggagaagtgtgaacagggacccatgtggaaaatggtaaggtcactttttccatgaggcgtctgggttgtgctggggatctgcaccagtccctagtcaccaagcactccacagcctgaaagcaacagcgacaagggctgtgagacagcaaaaatggcagcttacctctgcctgtgggagcttccatcccagggaaatggagagttgctatcagcccgagatctgccacagtgggtggcagggggtggctgtagtcccaggccagtaggatttaatccttggaggtacagtagaggtgaggcgtgcagtcagtagctgctcagccaactggattcagcccctttcctgggggcatgcaagggaacctgacctcccccattgacggagttacagccactattgcagggatccaagcttcctgggactccatatgtcctgagcggcagctttgcccaaattccctgtagccctgcatgacagtctgagagctacagactgtggagtgggctcacaaggggatgtcctgagcccagggttgcaaaggtctgtagtataagtatgggtccccggggactctaactcatgcgctatttccgggtagtggggaactctcccctggctctacgcccctcatgggtgggcagttgtcctgtgtggctcctctccattctctgtgggttgtttccttgatgaatcccaatgtgtacacctggatgtatcagttgaggagctaggatttactcaccaccttttattctatccatgagctagaagtacactagctgcttttagtcagccatcttgagaagaatccatttattaccttccctcccccgatattcttgccttttgtttgtcatccatcataggctgaaagaaacatgtcaaatatatagattaaatattcctagtgttttatacattccactttgcactttgttccctataatttttgctttatacattctgatgatagtttattttgtgcataaagattcatggaaattaaacccacattgtcttgtttacagctttttgtctgatttcatacttctatgatgataatagcatgctcctctttttaatttgcattttattactatgtttttgtccatcttttttagtttcattctttctttgtcatttttatcagctttattcatataaaataaactgaacatatttaaagtgtataatttgatcattttgaattacatatacacctgtaaaaccatcaaagcaatgaagacaatgtacatattcatcaccttcaaaagttttctcacccctcttggtaatccctgcttccagtccaaatctttcccaccctgtcacaggcaattactgttctgctttatttcactaaaggctaattggcattctctagatttttatataaatggaatcactcagtaggaaatttttgctgtctggcttctttcattcagcataattattttgagatgtatccatgctgttgcatgcatcattagttcattcctttcattcctttttattgctgagtagtattccattatatacgtatagcacattttgtttattcacttgttgattgacatttgggttgtttccattccaacgttgatggacatttgggttgttttgtccattacaaacaaagctgctatgaatattagtatatgagtattcacatatacatatattttcatttcttttgggaaactaggtagcagtgaactggctggatcatatggcaggtatatattttcagagactgccaaacttttttccaaagttgttaatatctaattttacattatcagtagccatgtattttactttgtttggatgctgaatacttttgtattcctttaaagtttcttagctttgtttttgacacagttaatttccttggaaagaaatttaatcctttgggggtcttataagttttgttaggcaaagacaagagcagtatttattctagggctaattttgctccttgatggatgcaagtcctttctgaggagtattctacctaatattactgaaatatgaacttttccagtttgtctggtggaaagagttattcctagctctttgtgaactccagagataattttccctgaccttttccgatgattctttccccagccttgggtagtttctttatatgcgtgtgtttatccgttctctcctgaatattcaagaaggaccttctgcagttttctgaagttctctctgtgcagctctctcttctatactcttttctgctaactctagccgttttggtctctccaaactgccaattctgtctccacagcacaagcatctgccaggttctaagtgagtttcccctcaagtcagtaagctgggacaattgtagacttcaacacagttgtttctcaccatttagagatcactgtcctttgttgcctgcattggtctgaatgtttgtgtccccttcctccaaattcatgtgttgaaagctaatccccaatgtgatagtcttaagaggtcagacctttggaaagtgattaggtcatgaatgcagagccctcaggaatgggattggtgccattataaaagaggttccagagagctaccttgtcccttccactatgtgaggacacagtgaaaaggagcagtctatgaaccagaaagtagtctctaaccaaacacagaatctactagggccttgatctttaacttcacagactccagaacagttgtgaaaaataaatttctgttgtttataagctacccaatttatgacattttgttatagcagcctgaatgcactaagacatcacctaagttccagtaccttgaaaagtattttatatatttcagccagtttggttgtttcagaaagggtagtaaatgtagcacctgctaccccatcttatttttagtgcaactctacacacacatacacattcgtattcagctaaatgtctttctcttaatgggtaaattatctcatttctacttattgacatgccaattcttgcttttatttgttgtttcatgctatgctttgtttataatttcttttgtgttttgtcttttcctttattatctacttttcctttgtttaattcaattgtgtcctctgaagttgatatagtttttagttccaaattctatgtcaataactatagttttatacaataaatttaaattatggtttatttatcaactgtagagaatacattagtgaccacccactataacggatgcaataattactacataatacttcccaaagttgcctccacctcctgatttcagttgtttgtgttcacatttttagctcttctgacagttgcatattatatatatatatatgatgaaaaagtcttatttcattggctttttaagcagttactatgaaaggtaaaggaataatatacttaaatattctcccaacttcgctctaagtttacaattgctaatttagatcagaaagagtagttacatcagggccaggtgcggtgactcatgtctgtaatcccagcactttggggggccaaggcaggtgaatcacttgaggtcaggagttcaagaccagcctgggcaacatggtgaaaccctatctctactaaaaaaaaacaaaattagctgggcacagtggtgcatgcctgtaatcccagctactcaggaggctgaggcaggagaatcgcatgagcctgggaggcagaggttgcagtgagccaagatcacaccactgcactccaacctgggcaacagagtgagactccatttcaaaaaaaaaaaaaaagagtagtaacatcattatttctatatcattaaaagttattgtggtagaatgtggatatataccaatctcatgatctcttcttaggaacatggaaagtctacattttccagcctcccttgcagctagattggctcatgtaaccaattctgctaaaggaatgtgaacaaaaatgatgtaaacaacatccaggtttggcttctagaatttcacatgaaaatcttccctttctgtctctcttgtgcattcacttgaaagtaaagaactgcaagacagtagaatcaaacattggaaagcgccttggattcctaagtcactgtgtggagagtaaccactaaagaaagtgactaaactttcagcagtgacgtgaacaagaaacaaccatttagtgagttaaagctttgatattttgatgctgcttattatagcaactaccaataattttcctaaatagtacaattgtttttattctggtatgtaaccatatatcccacattctattttaaaatgtgttccatgtttatcaccaatccttctattaatatttcttcacatgtatcttaattggttgaattttcacagagaacacttttcagaaattttgttatctatcctcataggacaaataatgaccccttagagatgtccagacactaatactggaatcctggaatcctggaatcctgataatatgatgtatgaaattgcaggagaaacttaggtgacagaattcaggttattaaccagctaacattaagatagggagattatcctgggtttccaaagagggactagtgtaattgcatgagccttgtgagactgtaagcagggaaaccagccaagctatgaaaccagcccagacttctgaactacagaaactgaaataatacatttacgttgttttaagccttgaaatttgtggtaacttgttacaacagcaatagaaaactgttacacctgccttcttgcacatgtctgtgatcataataattgagtgacaacttgactgtgtaaaattttggttggtcttattttcttctccttaagacattgcaggcacttcttcactatttgttttctagtattgactatcattgtatagaagtctgatgccaggctgatttttttttttttggcccttagagttgatttgatgggtcggagggtagcctgggcacacacaggcttcttttatttagaataagtggaagtagagtaatgttaagtagaaatagaataatgttagcagactatgtcatggtattgatatttttatatgacacaaaaggctaaaccaaaggacaagaaaagactgtatgtgaaaaagaaagtatgggcagtgcatattccatcccaggcatgcattgtgaatttgtgaaaggaaaagtagagcttgcaggtggcatttcccatgactctcagtttttaagaggctttctgaaaattctcagcagagacaagctatgcacttcaattatgcaggttatgatcttcttttattactgctctttgttttgtttcattttctgttctcttcttcagaaatattaattgcacatttgttgcatctttgttattttccatatttaaatttttccccaggtttttttcagatctgttttcttttatatttcaactctatcatttttcaagccacccaggtggatttctatacaatgattatgattgtatgttcagcagtacctaacctcatttaacatacaatgattatgattgtatgttcagtagtacctaagctctcatttctattattcttattgtgcttttcatttctctaaaaaaaaatttattctttcctgttacatattgatatggtttggctgtgccttcacccaaatctcaacttgaattgggtctcccagaattcccacatcttgtagagggacccaggggcaggtaattgaataatgggggccagtctttcccgtgctattctcatgatagtgaataagtctcatgagattggatgggtttatcaggggggttccacttttgcttcttcctcatttttctcttgccaccaccatgtaaggagtgcctttcaccttccaccatgaatatgaggcctccctagccatgtggaactgtaagtccggttaaacctctttttcttcccagtctcaggtatgtctttatcagcagcatgaaaatgaaccaatacagtaaattggtaccagtagaatggggcattgctgaaaagatacccgaaaatgtggaagtgacttaggaactgggtaacaggcagaggtgagaacagtttggagggctcaaaacaagacaggaaaatgcgggaaaggttggaacctcctagagatttgttgaatggctttgacaaaaatgctgataattatatgaacaataaggtccaggctgaggtgatctcagagggagataaggaacttgttgggaagtggagcaaagttgactcttgttatgttttaacaaagagactggaaacattttgcccctgcccaaaggtttgtggaactttgaacttgagagagatgatttagggtatctggtagaagaaatttctaagcagaaaagcattcaagaggtgacttgggtactgggtaaaagcattccattttaaaaaggaaacagagcataaaaatttggaaaatttgcagcctgatgatgcagtacaaaagaagaacccatttttttgaggagaaattcaagcctgctgcacaaatttgcataagtagcaaggaacctaatgttaatccccaagaccatagggaaaatgtctccaagccatgtcagagaccttcacagcaagccctcccatcaaaggtccgaggcccaggaggaaaaagtggtttcgtgggcctagcccagggactacatgttgtgtgcagcctagggacttggtgccccaagtcccagccactccagccatggctgaaaggggccaatgtacagcttgggctgtggcttcagagggtggaagccccaagccttagcagcttccacatggtgttgagcctgcaggtgcaaagaagtcaagaattgaggtttgggaatctctgcctagattttagaagatgtatggaagcacctggatgcccaggcaaaagtttgctgcaggggcggggccctcatgaagaacctctgctaaggcagtctggaaaggaaatgtggggttggggccccccacaaagagtccctactggagcactgcctagtggagctgtgagaagagggccactgtcctccagaccccagaatggtagatccactaacagcttgcaccatacgcctggaaaagacggagacactcaatgccagcctgtgaaagcagctgggagggaggctgtaccctgcaaagccacaggggcagagctgcccaagaccatgggaacccacctcttgcatcagcgtgacctggatgtgagacctggagtcaaaggagataattttggagctttaaaatttgactctgctgctggattttggacttgcatgggccctgtaacccatttgttttggccaatttctcccatttggaatggctgtatttatctaatacctgtacccccattgtatctaggaagtaactagtttgcttttgattttacaggctcataggtggaagggacttgtctcagaggagactttggagtgtggacttttgggttaatactgaaatgagttaagactttgggggactgttgggaaggcatgattggttttgaaatgtgaggacatgagatttggaggggccaggggtggaatgatatggtctggctatgccctcacccaaatttcaactagaattgtatctcccagaattcccacaagttgtgggagggacccagagagaggtaattgaatcatggggccgatttttctcatgctattctaatgatagtgaataagtctcatgagatctgatgggtttatctgtggtttctgtttctgtttctgtttcttcctcatttttctcttgctgccaccatataagaagtgcattttgcctcccactacgattctgagccctctccagccatgtgcaactgtaagttcaaataaacctctttttcttcccagtcttaggtatgtctttatcagcagcatgaaaatgacctaatacatatgtctttctggagctctgctagtacacttgtcatttctggtgtcttgtctcttctttgaatttgtgtacatcatctttgaggtcctgtttcaggcatcccatattttctttaatttattccatttcagagaaagatctttgttcaatgttttctgatgctttgtggcgtattttttgatgtatatacttcaactacctctgacttgtcatgtttctttccttatttccactgctggttccttttttttagttgttactcatcttttcattgggattaatctttggttaagaacataccctaaggaaaggagctaggataataagcttagataactggaaacttgacttctgttttaagaaaactttgtaactttctgtactgggggtatgtatctgctctgaagaagcaaaaaatatccatatgccacatatcctacatggaatggtttcatattcatttctcttttattggcccaagattaaaagctacagagtagattacaaaaaaatgtaataaatatccaccacatccatcttctgttctgtggtcatttctgaatataaacccctttagattttttttttttgagatggtatctccctctgtcacctaggttggagtgcaatggcacgatgtcagctcactgcgacctctgcctcccaggttcaagtgattctcctgcctcagcctcctggtagctgggattacaggcgcttgtcacaacgcccagctaatttttgtatttttagtagagatgagcttcgccatgttggccaggctggtctcgagctcctgacctcaggtgatctgcctgcctcggcctcccaaagtgctgggataacaggtgtgagccaccgcacccaaccccattttagatcctgagcactgggtttctccaggatttcatggggtggaggaaagcaataattacattgccaggtgccctatccatttcctaagacttcaagatccttgtctgtttttactttcatcatgaacttcaacctggatatttttattttcccagattattcttaaattgtttggtctcctaatagttttcacttctgaaagctttattctctattcatctttgctactgtagtattattcttgcttttacagttattctgacatcttgatggtgtttgaaaaatatgatgaagtgtcatcaaggactcaattttccatcttaaatcaaaagagtgtccaatggatttatatattttctaaacaatttagttgattgacctatatgtggagacacagatagatattatttaataggcagggaaggtacattgatataacatgaatacttggctgtgtacaacttctcagagaagtaatgcatttacttttaaccacgaagttggtttctctattgtcagaaagaaagaacatcaaaacagccaagacacctgctgtggaaatgtctctttcattgatctctgaaatctctattttatgctgactttcataagaagtatctaatcttccatactcgttcacctgggaagctgggatgttaactgccaaaaacctgcattgcaaaaacaaacaaacaaacaaaaacaaagaaactgaagaacaagaagaagctccatgtggatcagcaagcaagggcagtgtgagtccctttctaggtgtacctcatgaatttgcaagaggaaatacaagccttgcagatggcatttcctttggccattagttttcagaaggctccctgcaaattctcagcagaggaaatagcaggaatgataagtctatttccaaagccctttccaacaaccttcagatttcccgcattcagattgcacttaaaaatatcaaacgacttgccagtcttttcagcagccttctaaatacgtttctgttcaaagaaataatgggagtgacaggctgagaagtcaggaggcactcgataaatgtttctatgaatgagcgagtgaagtgaatgaaagtatatgggcatgaacgaaaagcctacaaatgtgagtctaaatctgtaaatgatcaaaaaagtatttttcctgagagaattatctcatctcaatttggaaacactaatttctggcctcggagagtgcatataatctattttctcatccagtcgattcacatttataaaagtaggtttttcttccagacaaagcacactataggaaaaagaaaaaaaaactgataactgtgttatgccctctgtctgagccttcaaatctctttggttcaaatgggaaacttgtttctgctggctttcatccagtgttgcagcacttcaagaagtttcagctgcattagacttgctctcagcccattaaaacccataaaccctccaagatggccgaataggaacagctccagtctacagctcccagcatgagcaacgcagacgaggggtgatttctgcatttccaactgaggtaccgggttcatctcactggggagtgtcggaaagtggttgcaggacagtgggtgcagtgcagcaagcgtgagctgaagcacagcgaggcatcacctcacctgggaagtgcaaggggtcagggaattccctttcacagccaagcaaagctgtgacagatggcacctggaaaatcgggtcactcccaccctaatactgcacttttccaatggtcttagcaaacggcacaccaggagataatatcccatgcctggcttggagggttccacacccacagagcctcactcattgctagcacagcagtctgagatcaaactgcaaggtggcagcaaggctaggggaggaaagcccacaattgcccaggcttgagtaggtaaaaaaagcggcctggaagctcgaactgggtggagcccaccacagctccaggaggcctgcctgcctctgtagactcaacctctgggggcagggcatagccaaacaaaaggcagcagaaacctctgcagacttaaatgtccctgtctgacagctttgaagaaagtagtggttctcccagcacggagtttgagatgtgagaacagacagactgcctcctcaagtgggtcactgacccccgagtaacctatctgggaggcaccccccagtaggggcagactgacacatcacatggccgggtacccctctgagacgaaacctccagaggaacgatcagacagcaacatttgctcttcagcaatattcactgttctgcaccccccgctgctgatacccaggcaaacagcgtttggaatggacctccagcaaatgccaacagacctgcagctgagggtcctgactgttaaaaggaaaactaacaaacagaaaggacatccacaccaaaaccccatccgcacatcaccatcatcaaagaccgaaggtagataaaaccacaaagatggggacaaaaccgaaaagaaaaactgaaaattctaaaaatcagagcacctctcctcctccaaaggaacgcagctcctcaccagcaatggaacaaagctggacggagaatgactttgatgagttgagaggagaaggcttcagatgatcaaacttctctgagctaaaggaggaagttcaaatccatcacaaagaagttaaaaccattgaaaaaagattagacgaatggctaattagactaaccaatgcagagaagtccttaaaggatgtgatggagctgaaaaccatggcacgagaactacaggacaaatgcacaagcttcagtagccaattctatcaactggaagaaaggctatcagtgatggaagatcaaatgaatgacatgaagtgagaagagaagtttagagaaaaaagtaaaaagaaatgaacaaagcctccaagaaaaatgggacgatgtgaaaagaccaaatctacatctcattggtgtacctgaaagtgacggggagaatggaaccaagttggaaaacactctgcaggatattatcaaagagaacttccccaacctagaaaggcaggccaacattcaaattcaggaaatacacagaacgccacaaagatactcctcgagaagagcaactccaagaaacataactgtcagattcaccgaagttgaaatgaaggaaaaaatgttaagggcagccagagagaaaggtcgggttacccacaaagggaagcccatcagactaacaacagatctctcggcagaaactctacaagccagaagagagagggggccaatattcaacattcttagagaaaagaattttcaacccagaatttcatatccagccaaactaagcttcataagtgaaagagaaataaaatcttttacagacaagcaaatcctgagagattttgtcaccaccaggcctaccttacaagagctcctgaaggaagcactaaacatagaaaggaacaactggtaccagccactgcaaaaacacgccgagttgtaaagaacatcaatgctaggaagaaactgcaccaactaacgagcaaaataaccagctaacatcataatgacaggatcaaattcacacataacaatattaaccttaaatgtaaatgagctaaatgctccaattaaaagacacagactggcaaattggataaagagtcaagacccatcagtgtactgtattcaggagacccatctcacatgcagggacacacataggctaaaaataaagggatggaggaagatctaccaagcaaatggaaaacaaaaaaaggcaggggttgaaatcctactctccgataaaacagactttcaaccaacaaagatcaaaagagacaaagaaggccattatataatggtaaagggatcaattcaacaagaagagctaactatcctaaatatatatgcacccaatacaggagcacccagattcataaaggaagtccttagagatctacaaagagacttagactcccacacaataataatgggagaatttaacacacgactgtcaacattagacagatcaatgagacagaaagttaacaaggatatccaggaattgaattcagctctgcaccaagcagacctaatagacatctccagaaatctccaccccaaatcaacagaatatacattcttctcagcaccacatcgcacttattccaaaattgaccacatagttggaagtaaagcactcctcagcaaatgtaaaagaacagaaattataacaaagtgtctctcagaccacagtgcaatcaaactagaactcaggattaagaatctcactcaaaactgttcaactacatggaaactgaacaacctgctcctgaatgactactgggtacataatgaaatgaaggcagaaataaagatgttctttgaaaccagcgagaacaaagacacaacataccagaatctctgggacacatttaaagcagtgtgtagagggaaatttatagcactaaatgcccacaagagaaagcaggaaagatctaaaactgacaccctaacatcacaattaaaagaactagagaagcaagagcaaacacattcaaaagctagcagaaggcaagaaataacaaagatcagagcagaactgcaggagatagagacacaaagaacccttcaaaaaatcagtgaatccaggagctggttttttgaaaagatcaacaaaattgatagatcgctagcaagactaataaagaagaaaagagagaagaatcaaatagaggcaataaaaaatgataaaggagatatcaccaccaatcccacagaaacacaaactaccatcaaagaatactataaacacctctacaaaaataaactagaaaatctagaggaaatggataaattcctgaacacatacaccctcccaagactaaaccaggaagaagttgaatctctgaatagaccaataacaggatctgaaattgtggcaataatcaatagcttaccaaccaaaaaaagtccaggaccggatggattcacagccgaattctaccagaggtgcaaggaggagctggtaacattccttctgaaactattccaatcaatagaaaaagagggaatcctccctaactcattttatgaggccagcatcaacctgataccaaagcctggcagagacacaacaaaaaaagagaattttagaccaatatccctgatgaacatcgatgcaaaaatcctcaataaaatactggcaaaccgaatctggtagcatatcaaaaagcttatccaccatgatcaagtgggcttcatccctgagatgcaaggctggttcaccatatgcaaatcaataaacgtaatccagcatataaacggaaccaaagacaaaaaccacatgattatctcaacagatgcagaaaaggccctcagtaaaattcaacagcccttcatgctaaaaagtctcaataaattaggtattgatgggatgcatttaaaaataataagagctatttgtgacaaacccacggccaatatcatactgaatgggcaaaaactggaagcattccctttgaaaactggcacaagacagggatgccctctctcaccactcctattcaacatagcgttgtaagttctggccagggcaattaggcagaagaaagaaataaagagtattcaattaggaaaagaggaagtcaaattgtccctgtttgcagatgacatgattgtgtatctagaaaaccccatcatctcagcccacaatctccttaagctgataagcaacttcagcaaagtctcaggatacaaaatcaatgcacaaaaatcacaagcattcttatacaccaataacagacaaacagagagccaaatcatgagtgaactcccattcacaattgcttcaaagagaataaaatacctaggaacccaacttacaagggatgtgaaggacctcttcaaggagaactacaaaccactgctcagtgaaataaaagaggacacaaacaaatggaagaacattccatgctcatggataggaagaatcaacatcgtgaaaatcgccatactgcccaaggtaatttatagattcaatgccattcccatcaagctaccaatgactttcttcacagaattggaaaaaactaccttaaatttcatatggaaccaaaaaagtgcccacattgccaagtcaatcctaagtcaaaagaacaaagctggaggcatcaagctacctgacttcaaactatactgctagtctacagtaaccaaaacaccatggtactggtaccaaaacagagatacagaccaatggaacacaacagagccctcagaaataataccacacatctacaaccatctaatctttgacaaacctgagaaaaacaagaaatggggaaaggattccctatttaataaatggtgctgggaaaactggctagccatatatagaaagctgaaactggatcccttccttacatcttatacaaaaattaattcaagatggattaaagacttaattgttagacctaaaaccataaacaccctagaagaaaacctaggcattaccattcaggacataggcatgggcaacgacttcatgtctaaaacaccaaaagcaatggcaacaaaagccaaaactgacaaatgggatctaatgaaactaaagagcttctgcacagtaaaagaaactaccatcagagtgaacaggcaacctacagaatgggagaaaatttttgcaatctgctcatctgacaaagggctaatatccagaatctacaaagaactcaaacaaatttacaagaaaaaaacaaacaaccccatcaaaaagtgggcaaaggatatgaacagacacttcttaaaagaagacatttatgcagccaacagacacatgaaaaaatgctcatcatcactagcctttagagaaatgcaaatcaaaaccacaatgagataccatctcacaccagttagaatggcaatcattaaaaagtcaggaaacaacaggtgctggagaggatgtggagaaacaggaacacttttacactgttggtgggactgtaaactagttcaacccttgtggaagacagtgtggcgattcctcagggatctagaactagaaataccatttgacccagccatcccattactgggtatatacccaaagggtcataaatcaagctgctataaagacacatgcacacgtatgtttattgcagcactactcacaatagcaaagacttggaaccaacccaaatgtccaacaatgatagactggattaagaaaatgtggcacatacacagcatggaatactatgcagccataaaaaatgatgagttcatgtcctttgtagggacatggatgaaactggaaaccatcattctcagcaaactatcgcaaggacaaaaaaccaaacactgcatgttctcactcataggtgggaattgaacaatgagaacacatggacacaggaagggaaacatcacacaccagggcctgttgtggggtggagggaggggggaaggatagcattaggagatatacctaatgtaaatgacgagttaatgggtgcagcacaccaacatggcacatgtatacatatgtaacaagcctgcacattgtgcacatgtaccctagaacttaaagtataatatatatatataaaagaatgcagccaaaaaaaatcccataaaccctagggagacttcagagggattcaaaataggaagaagtccttttaccaagaaacttgatagaagccaagatctacatcctcagacaaaaggtaagtctataatgatatggtttggatttctctcctcacccagatttcctgtcgaattgtaatccccaatgttggaggagggccttggtgggaggtgattggattatggaggcgaatttccccttttctttcatgagaacagcaagggggaatgctgagtgagtgagttctcatgagatctggtttttaaaaagtgtgtagcaactcccccttcgctctcttcctcctgctctgaccatgtaaagacgcgctggcttccccttcaccttccaccatgataccaaatttcctggggcctcctcagccatgcttcctgtatagactgcagaagcaggagccaattaaacctcttttctttacaaattacccagtttcaggtatttctttatagcagcatgagaactaactaatattaatacatatgccttccctaaattgcatagagattgattatttcacttcatgttggtaaagaatttatatagatattaaaacaacaacaatgacaagtgtctggacattaagtatattatttatttagaaaatccttgagggctattatgaatatctaaggatgctataaagaaaataaaaataatttacttcagtctctagtataggaactttcatgatttgctatgaaccatacccatactcctattatattctgaaatgaatgattcatggcattgatatggagaaaattttaataaatatacaaatgctcggtaaattgtgcaaggttatacaaatatgtgttgtcctgttgctggtattcttatacttagatgtcagtagtggaattaaagtaatctaaagaataattagaatccctttgactcaactcttctcacagattagctataacctaacattttttagggaaataatgtattaattactgatctcttgccttttaaaactttcagctcaaacagttttctggaagatttaccttaagtgtttcctctctttccaactggagtaatggtaactcagtgacaaaatgatggacagggtgactaagttccttggcccatctctatctgcaccttgggaatgatcatattgactcccccacttttttttcagtgattctgtcaagaaaactgtaagaaaaggtctccaacatcctaggaacagagagatataatcaatttaaggtattctacacataacccaatttgtccatactgccatcccccagtaagcatggagtatgatgaattgatgataatattcatgcaaatgtttgatcatgatagaattaattttgctctgatgtagcctggtccaaagtcactggagaaaatattgcagtgaaaaaactttacacatcaaaatgtttgtcaatgtccaacaaagggcttaatgatttcagcagtatttgacacaatattcttaacaaaattaggatttggcacagtccctaaagtttattataagaagattttaaaattatgttacttaaagtcccatgtgatgaaaaaaaatctttaaatgtgctcatccagcctatgcacaaataacaataatagaaatttcattaaaagccctgaatattcctttattgaaagcttagactcccttttatgagaaaattatcaacaaactaggaatagaatggcaattcctcaacctgataaagggaatctatgaaaaacccacagaaagcatcatacttactcatgaacaagtaaatgctttcctcctaattcaggaacaaaacaggaatgtccagccttgccagttctattcaacattgtactggagattctagacagggcaattaggcaataaaaagtaaaaggccaccagattggaaggaaatgggtaaaattttctctactttcaaatgacatagtcttatttatagaagatcctaaggaattcactgaaaaagagggaaaaaactattggaacaaataaacaaggttgcaggatacaagatcaatatacaaaattcacttgacctaagcaacatgaaaatgaagttaagaacaatattctattgacaatagcatcaaaaagaataagctgcttaggaataaaattcaaacaaaaattgccaaatttatactctgaaaatgataaaatactgttgaaataaattaaagagatctaaaaaaggtggaaaaacaccccatgttcatgtatcagaaaatttaatattgttaaaatggcaatattccccaaactaatttacgtatccaacacaactcctatcagaatcccaactttcttctttataaaaattgacaagctgatcctaaaatacatatggaatttcaagggacctggaatatctaaaacaattctagaaagaacaaagtaggaggattcatgcttgctgataagactcactacaaagcaatagtaattaagatggtgtattactgacacaaagataggcattatatatagctagaatagaattcaaagcccccaaataaactcttgtatctatggtcaactgatttttcaagggtgccaacaccactgaatgaggaaagaaaaatcttctcaaaaaatgatggtgggaaaactagatagccacatacaaaagaatgtagttgaaccctcacctcataacatatataaaaaggaactcaacatggatcagagacccaaaaataagaactaaaactacaaactcttggaagaaaacatgtggctacatattcatcatcttgggtttggcaaaagattctttgatatgacaagcaaaaatataaataagttgaaacttatcaaaattaaaaacctgttgtttcaaagtgaagactatttaaaaagtgtaaacacaacccacggaatgggagaaaatatttgcaaatcatatacttgataagaggctatgaatatgtatttcccttaaataattaagtaagctatagtaagtttaacctaaaaattagacctaatcctgagttctataggtttgctctgatttcattcagaccctgggtttaaaagaatcccatgaatatctcacaagtgcaggcaaccaaaacaaacatagagaaatgagattacatcaagttaaaaagctcctgcacagccatggaaacaatcgacaaagtgaggagacaacccacagaacgggagaaaatattttcaaactatccatttaacaagagataatgaccagaatatataaggtgctcaaacaactctacaggaaaaaaatataataatccaatgttaatatgggcaaaatatttgaacagatatttctcaaatgaagacatacaaatagcaaatgggcataagaaaaagtgctcaacataattgatcatcagagaaatgcaaatcaaaactacaatgaggtatctcactccagttaaaatggcttttatccaagtcaggcaacaacaaatgctggcgaggatatggagaaaagggaattcctgtacactgttggtgggaatgtaaattagtacaaccactctggagaacagtgtggcggttcctcagaaagactaaaaatagagctaccatatgatccagcaatcccactgctaggtatatacccaaaagaaaggaaataagtatatcaaagagatatctgcactcccgtgtttgttgcagcagctctgtttacaaaagccaagatttgcaagcaatctaagtatccatcaacagatgaatggataaagggagcactattcaaccatgaaaagaatgagatcctgtcatttgcaacaacatggatgaaagtggagatcgttatgttaagtgaaataagccaggcacggaaagacaaacatcacctgttctaacttatttgtgggagctaaaagttaaaacaattgaactcatggagatagagagtagaaggatggttaacagacactgggaagagtagtggggaacttgggagaaagtagggatagttaatgggtacataaggtagttaaaataaacaagacctagatttgatagcacaacagggtgactatagtcaaaaataatttaattgtacattttaaaataactaaaagagtataattgtttgtaacacaaaggataaatgcttgagggaatggataccccatttatcatgatgtaattattatgcattgcattcctatatcaaagtatttcatgtaactcataagtatatacacctactatgtatccacaaaattaaattttaaaaagataaaagaatcccatgaacttgtctatgtcttaatatctccaagcgtcttttggatttcacaaataatttggtcctgacagcacttatgtgcagtacctaaaacagattactattcactattgcacaaacagaaataggttaatagacttactaaagtcataggcaagtttgtgacagagccaagactagaacctacatctccctacaggccatttacatttttatattgaggtcatctgtgatagaattgtatttttaaatatgtgccattagattaacacatttgttgcaactcttgtgtcaaagacacaaaaagctttggaaactaaatcacattgcttggcttctgtttgcttagaacattttttttttcactgtttttaagtctttaaagttccttcactttcatcttaaggaagtgttctactttttccctactgtttacaattaatacatcattatggggctggaagtttcaggtgaagttaactgccaagtctgccaacttcttaacaatgcccaatgtgtcatctttgggggtttgcaagaaacagtttttaattgctcaactttgagcagtgcactaaagctaatcatgcccctagagcctggaagaatctctgagatacaaagctatcagaagtgttctgtttgtccagcaccaactaaaagcaaggcaggcaggaagaacattatttcaacttaacaggggaaacatcatttttcaatgttgagacaaatttttttaaaaatctgtttaaaggctgttaggagatgcttggctggttagtcctctccagcacctcatctcccattttttttttctgctaacccatagatcaggactacctcataatagaagggcagacttgtcacttgctactttaggattatgaatttgtgcataactccatacaggcactcaaagactatgacaaggaattgtttagagcacagttagacctttggaataaattgcacactctcttttttgctcaccctctaataatttttcaagagttcaccaaaagcacatttattgaaggagatcttctactagtcacagtctttccaaaccagtaaaatatattcccaccagctgggtccccaacttctgccactttccctttgcccacagtgcttcctcctattcagcatcctaaggccttaatttgactgttaggatacatccctgcactaagctgaagaattcattagtgtttccgttttcctcttactcagatctgctctagcaccttttagctaggtcctaacacaacttccttagttgtcttccatatacaaaaaagatatttatgatctgctttcaatagaaacaatttctctagaattacgaataaagtaattggaatgggcctcagagatagtctatacagcaaaagaaactgaagcccaaaaatttgaagtgactttcccaaagccagacagtttgtgaagagttcatgctctccttacgtcctcccttctggcaaatatgagaaatgacatattagagatgcatttagtgaccatgaggctgactgaagctaagctattctcataggaaccaatcctatatcttaaatattactgtgttatgattggcagtgaaacaagccttagctaaagacagatgtcttaatgtggtacccatatcatgtcactttgagttatccaaggacctgaacaaaatcttgctgagtacaaaatctgagaaatttgtcctcaaagcaagtatcaagcaaaagaccatatgtataatttcccaaaaggcactggtctggaagtaagaaaatgagttttctatccatctctgtttctaattaattatgtgacatttggccaactcacttgattgctttaggcttcagttttctcagctataaaaactgtaggtactaatttatgtgaatgcattgggaaaagtaaaaatagctaacatgctaatatttattgagatttaccatgtgccaggcactgtcctgggcattttatatgtatttcctcacttcataaacaaggaaaattaggcccagattattcagattacctaaaaaaaactccacagagttagtaagtccctgagtacacaaccttagccattaccccagactgcctctccttaccctatattgtgtctactgccactaccactaaaagtgttaaaaaggccaggcatggtgtctcacacctgtaatcccagtgctttaggaggctaaagcaggaggatcgcttgagaccaggagttcaagaccagcctgggtaacacagtgaaacccaagctctacaaaaaaaataaaataaaataattaattagccaggtgtggtggtgcgtgcctatagtcctagctacttgggaggctaaggcaggaggatcccttgagcccaggaatttgaagttgcagtgagctatgatcatgccactgcacactagcttgagcaatagagcaagacactgtctctaaaattaaaaaaaaaaaagagttgaagaagtataaaaacaattatctgtgcgcagattacttatgatatagtttaaggttcgggtaacattgaaacacaaaagaaccaaagaattaagctgagccttgaaagacagattgggtaagctttagctttacaaattagtagaacattagaagcactggtgcaaaagaagtgggagtgagcatgggggtactcatggagcaatgaagaaactaacctgactcaagtagagagattgtattgaggagccatggagacaggggcgaacatgggaatcaataaaaccctttatcaccatatagtttgcttacatagcacttatcacaggtgcatatttgtattttttttttaatttttgtgtttgtacatagtagttgtatatatttatggggtacatgagatactttgatataggcatgaaatgcataataatcacatcatgggaaatgggatatccatctcctcaagcatttatcctttgtattacaaacaattcaatatattctttcagttacttttaaaggtacaattaaattatttcgattatagtgtgctagcaaatactaggttttaataatcacatcatagagaatggcataggatatattcttgattgttagttaatgttaatatcaatttcccccaaaaacagtaagcttcctgaaggtaagaaccactttattcagcataacactggaagtcctagctagagcaatcagacaagagaaagaaataaagggcattcaaatttgaagagaagacgaatggtttgttgttgttgttgttgttgttgttgttgttgttttgcaccattgtatcctcagtgccaaatacattgccagacacattgtaggtgctcattaaatacttgttgaataaatgtattcatgtgtgaatgaatgaatgttaaataatagatgaggaattgtcatacttgaccttgcatgtcagatgaggaaatatagccttgacagagactttgatcaggctggggtgctggaagtggaactgaaaagccaaacataaaggctgttttaacatggggatcaataacacagttgctctctgttgtgcactctctataccagctgtcccctgatagacatttctctaccagttgcaggctctgtcatgacatcagtttcatacagaaagaatgtgaagaaactgtaggccaaaataaaaaaagaattatttcttagttctctggaaaggccagtagtggtatacaaaagtcccacagtctcaaaggtctcctttctcttttctttacttgttttccctacacaaaatgccactttgtgttttgttttgtttttcaaacagctctgatttggcaaaacttcattgcctgtttgggatgaggtccctgaagctctcagaagataattatttctttctggtaaagatcagaaactttgaactctacttgtgagataaatggtctggtggcactttgaaacttcaacttatttaagttactgagcagctcatcaacttacttcctgcatttggaattgaatctgaaagagaattagaccccagacatcttgagtaggccaagtaggtacaatttatagattttgttcagagccaaacatgctcccagagatagaggcctggtgacagcttccagataaacatatagattgatggaatctacaaaccaaactgctcaatgaaaggcaggttctggtcagttatattttctaggtaaatgaggggtatccagacattttttgtttcaactccattataatgcttttgaaatgctggagtctattctccagccttagtgggcaggtagagtgactgatattcgatctttttgctgattgagggatgcacaggaccttgtgggtatgaaattatacatttttactactgagcactgagaagaggttgtggagaaagagtaggaaactggtagggtatgtacagagcccaggacctttcctaggcatcatccaatttagtttaaagccctgggtgcagaatgttttgttattgttttcctttttttaagaaagtgacaatttggtttagttggattccatttcaccaagataagataatacatagataaatattgccaagaggcaatggatgtctaaactagaaggttgcaaattgaaataacctaagggtcttgatgcagagcattcaaatgacctcaatcctgtatatgtcataacttttctagggaagattgaataaggttgtatgtaggtcaaatgccattgaaagaaatgtttgtctaagacattaaataatttaattagataccattaccaagggctgcagatcaaagggtttgttgattgagatttgacctaatctaaaagaattttctttcttcaggggtttctaggcatttgtgagtttgagaagctgggaaggcttttgaaatattgccaggaagtttgcagggagatcgtcacagtgctaaacctggcaactcttggagaattgttcttttgggcagcccattctgttccatctactgatacttgagagggacctccactggtgagtaggtaacagaacaggttttaatttattttcttttctcctttcctcctcttcttgggtctttaaccatctatctgggatggacaatctccaggaagacaagaggcagccattagttaaaaggaaagttatgctatatcaataaataattgcaggtaacaggactaagatgggaaacatgctgggttcagtttgccagaaatttttaatggtaattctaggatgaggcaatcagcactgtctctggaggccagggcctagactaaatgaaaaatagcccccccaatttagatgctgagtagcctttaagtgtgagagggaaattgtcatcaattttagttctatgggtccaaacatggtactaatgggggcaaggtcatgagttcaaccccaatctctatcagcaagtttaaccccatttaaaaaataagtcgatctcacagccatagactgatcaccaatttttagtcaaatggctcatcaatttattctactgggctcatgagggactgagggatagaaactttataaaccctccttcaatactggaaaaacaaaatacatcctgtggctcactgggaatgatagattcatataaggaggaaaaacgtctattttatcaatatttaatatttgacagcaaaagcagtgtgttttatagagttctaggaggaacatatagttttaaatggcataataatcagccatccacttcaatgcaaaatcagttcactctcccatctgtggccggcccattatctcattaaatattccactgtgaaagacccatatgtagataattgggagctaaatatactcccaaatattcaaaaaaaatttaagatatgactataccaacttaaatataagaggctgcgggtcattgtttcatgtagccatttgactcatatatttgtatgttctcactctgtagagatgattttctctattttcacttggaaaggtggaggcaggccaaggcaaaatctctttctcggggtcctatgataaatgaagacagcggcagcgttaggtctctcaagctctgagggcactcctgtgaagccaggtcaccaccaccctctccatcccttacatttgtttccctcttcacaaatagcaaacactttcctggatatatggatttacctttgttgtgcacctagcctatctgataggctgaaaaaggtagacaatgtgacacagggatagcttactagaaggccatgacatggaagggaaacgttaggaaattttctttcttaaagacttttaagggccaggagccgtgtcttacgcctgtaatcccagcactttgggaggctgaggcgggcggatcacctgaggtcaggagtttgagaccagcctggccaacatggtgaaatcccgtctctactaaaaatacaaaaattagctgggcatggtgtcgggcacctgtaatcccagctgcttgggaggctgaggcaggagaatcactggaacccaggagacggaggttgcagtgagccaagactgcgccactgcactccagcctgggtgacagagtgagaatctatctaaaaaaaaaaaaaaaaaaagatactttttaggacaagacaagtgagagagtttcccatttcagagatgattagggatacttcatttcttagaaaaccgcttctgtagcctacatgtctctccaacaaaggagaaaaatgtaacacatttcaatactctgcggagtgagttctttttttctttatctgagggaagtcgagaatcctagcttgttaaaactagacgggaccttagagataatttagtttaacaagattggaaataaaaattcaggcacgtaaggggaagaaacttgtctagagacatagcaagtgagtagcggaagctgcaaggaggggattagaaagaaaatgggagttagtctcatggagaaacacatatacatcaaaggggtgcttagcatagaaacagtaatgtcaagggaagaggcagatggaaaaagagaggttgcctttcaataaggaacagcaaaagaactccattcacacattccttcagcaaataattattgagctcctatctaggtactattctatattttgggcacacagcaatgaagaaaacagaaaaaccctgacctcactgagcatacattctagttgatagagacaagcaataaacataattaatagataagctatacagtatgctagatgtagttctaaggagaaaataatgcaggaaagggggatataaaatttcaatggctagaaatgaactcccagacgaggtgacccagaaaggatgtaatgcaatttcaggggctggagatgaattcctagatgacgtgacccaggaaggatacactgaaaagatgccttgtaagtaaaaacctgagggaattgagaaggtgagctgtgcaaggatctgggtttcataaatatggagcagaaagtttttacaaatatagaacagcaggatcaaaggctctgtgaaagggatgggctttgagtatttgaggaatggtgaggaggctagtgtgactggagcaaagtgagcaagggaaagggtggtaggagatgcgttcagagaggaggtgattgggaggcaaaccatatagggcctcgtaggtcatagtaaggagattggtgtttagagaggctgaaatgagaatctatagttaacaatatgatactgtatacttaaaattttattaagagagtaggtcttatgttaagtgttcttattacaaagataaaagagagaaggaggaaacttttagggatgtttgttatatttacggcattatttatggtggccgtttcatgagtatatacttatcttcaaactcaagatgtatacataaaatatgtgtacctttttgtatatcagtcatacctcaataaaaatagaataaattttttaatggaagagtgacctgatttcacttacagttcaactgaatcatctgaactggatgggaagaagactagaaacaggaaaaccaatgacgaagttactggaaaaatccaggtgaatgatgatgatgccttggaataaagaatggcagtgcaggtggcaagaggagtaggtagattctgaataacagctctgaatgcttaggactttatatattcatttactacctattgggttcttgtgatcccccaggtactgttctatgttctaggaatacaccagtaaacagcagacaagggccctgttattaaattcacatttgagtgaaagacaaataataagcaagtaatcaaattattaatataacttcaggtattagaatgtgttataaaaaatgaagcagggctaggggaaagagatgggtgaggatgggataagagagccttttcagtgaggctacgtactcagaccctctccttaccacccacacttttagaaacttcatgttcagttttcatactcctaactggggctcaacgacaacagaatagaaaatgtaggagaagctagaaatgtaacttcagcaggggatattagaagagggtcctcccagacctcactactacatctacataatatcagctcaggtcaaagagctaccttgcacccactctatgtcaggcaccgtggtaaattctggaactatggaaaaatgaaggcatgcacaatctaggagtgagagacatcccaaacatagacaatattttagctaagacatgtgtcagaaggtaccctgttggttgagattaataactcaagctaactgagattcaaccatgtctacatatcagatttatcttggaaaatgacgtgagaaagtcaggaagatggcctacctttcctgtcttcttagttaggaaaaattattcaagaagacctctagtggaggagggctggagaaattttcatataactattttcaaaaagataaggaactttccattttcttaggattgagggaggatatctagctttgcctctgttcccattatagatatctattccatttgtgtcccattcttctgaaaaggacaaagataatgatcctgcacaccctaattctttccacctttctcacaccctccatctttattcccattctttcaggtaacactaagtagccaattggcatccatttaatgaatagtggcaagagggaaagatggccatggacaatgtcacagcagtgtttcagtttctccttattggcatttctaactatcctcaatggagagacacgtttttcacattagtgctgataatttacctcagcacattgttggggaatggatttatgatctttcttattcactttgaccccaacctccacactccaatctacttcttccttagtaacctgtctttcttagacctttgttatggaacagcttccatgccccaggctttggtgcattgtttctctacccatccctacctctcttatccccgatgtttggctcaaacgagtgtctccttggctttggccacagcagagtgcctcctactggctgccatggcctatgaccgtgtggttgctatcagcaatcccctgcgttattcagtggttatgaatggcccagtatgtgtctgcttggttgctacctcatgggggacatcacttgtgctcactgccatgctcatcctatccctgaggcttcacttctgtggggctaatgtcatcaaccattttgcctgtgagattctctccctcattaagctgacctgttctgataccagcctcaatgaatttatgatcctcatcaccagtatcttcaccctgctgctaccatttgggtttgttctcctctcctacatacgaattgctatggctatcataaggattcgctcactccagggcaggctcaaggcctttaccacatgtggctctcacctgaccgtggtgacaatcttctatgggtcagccatctccatgtatatgaaaactcagtccaagtcctaccctgaccaggacaagtttatctcagtgttttatggagctttgacacccatgttgaaccccctgatatatagcctgagaaaaaaagatgttaaacgggcaataaggaaagttatgttgaaaaggacatgagccttctttgcttctaaacgtctaaaataacacaacgtccctgatggagaaaatggtttaaaggatctgactttatctttggaagtgattgacatatgagaagcttcaggaagtgctcccaccccaaatattattcctactgagacttgaattgccattagaggtattatttttgctctttctttacatagaatattgttagtggctacccattaggttactcaccttcaggtaaatgaacttatcagagtaattttctcactgacagaagagacctatacagcaagagaatcttctgtaactgttgacagcaggtgaggcataactgaaattggaaactaagacaaagaatggtataataaaaggccagaagacaaatgtcagaaactttacaactttactgagggtaagccctgttacgtaagcacaatctccttgtttcacttaatcttggaatcatgagaaaaattatcatagctatttcctacatttgtgtagagtgttttatttttgctttttgtttttcaaaacatctttctaatctattagtctattttatatccctaattttcctatggaattggtaaaaacaccaccacaatttccctctgtattaacaatgaggaaacagagtagacattgagactcatctaaagtcatacataattgataatggagtcaaaattagaatttagatcatatatatgccacctccgaatttgtaaaagtaagtctgtaaaattatttagaatcatagaattataaatacagctaccatttattgagaacttatgatacgctaggggttgagcaaagctctctatatctattatcacatagaattcacacagtggttcaatgccatggcactattttccatccatatttagaagtgtggaaactgagtgatttgcccatggccacagagccagtacttaaatctaggtctggttgattccagatcccacttactatatctaaaggcataagaaaccctagagatgactaatgtagtgatattttaatccactttatcatgacataatttgtatacaataaactttgtccaattacagtgtgcaattctatgagttttgacagatgctcacagcatcaccacaacaatcagctacctaacaatttcatcacctacagaagtttccttttgccttcttgtaacccatcccttcctccctctacccccaattccaaccagtgatctgatttctttcactatatgttagtttttgtttttttaaatattgactataaataaaatcatgcagtctgtactcctttgtgtctgggttctctcactcagcctgctcttgagattcatctatattgttgcatgtatccgtaatttgttcctttttattgctgaataatatttcattgcacacatttaccgcatcttaaaacccattttctgttgatggacataatgcaatgtttttcaaatcttgatttatatagtttttagggactcaattgtggtgcctggagcctgctaatggggggtcgtttcctgtgagctatttcatttgaaaagggagttctaaaactaaaaggaacggttttgataaacaatgatctattacaggtaaccgattttagatgagaaatctaaggctcactgaatgtggagtaaatttcccaagatcatgaaactgtttggaagcagatctagaacgaagacccagatatcctgtctcctggtctcactttactttgggcctccaccacatatgatgaagtcatctcccaagaagccttttctacctgtttgtgaggaaccagacacaaacaggtagaaaaaaataaaatgcacagtacccagcactactgagcaaacagatactcagtgtgttcctcttactgtgactgctggggggctgaagagacattgtatggtgttgcaaagggagtaccatggatacaaggagactgtcttacgtgtttactaactaaatgaaaaataattgaggatgaataaactacttatcaaaacagcttaatttcaaaacaagtgcaagatttattcaaaccgtatactttttttttaattattatactttaagttttagggtacatgtgcacaatgtgcaggttagttacatatgtatacatgtaccatgctggtgtgctgcacccattaactcgtcatttagcattaggtatatctcctaatgctatccctcccccctccccccaccccacaacagtccccacagtgtgatgttccccttcctgtgtccatgtgttctcattgttcaattcccacctatgagtgagaacatgcggtgtttggttttttgtccttgtgatagtttactgagaatgatttccaatttcatccatgtccctacaaaggacatgaactcatcattttttatggctgcatagtattccatggtgtgtaagtgccacattttcttaatccagtctatcattgttggacttttggattggttccaagtctttgctattgtgaatagtgctacaataaacatatgtgtgcatgtgtctgtatacatttttaaaggtacatggtactcttcatctctgaaataatgttttaatattgagaaagaaaaaaattcagaaaaaggcaaatgaattcaatctttaatttatccatttaacaaacattaggtttgtactttaaggcaggcactatgctaggtattagggtaagtctcatgctttgtgcaaaatgttccttactatcaagataaacctttcaagcaaacattgtgaaataaacataaactggcacaatcaatgaaatattaaaagaatcaaagagtgtcttcgcacagaggaaaattcagaaattaggtggaatattaagagtataggttttaatgattctgcctttggagggaaaaatatttcactctctattacaggttggtttacagcttaaaatgggatgcacattttcaataatggtccctctactacaaaatagtatagctatgtcactaggttctttctccctttattgacttgttggtatgggcacagcctacagacagagtgacatagtggagtctggagatgaaggttgtggaattgattctgctactaacaagctgtgtaaccttagttatatctctctctggcctttaaacttgcttatcaatataacaggaagattgtgtttagctacctaaagacctctctagttctaacattctgcatccgggtgttattttatatagggcttgctcttattttcttaaaaaatgcaagcatatcatcaatttactctgcaacttgctttttccacttgacaatatatcatgaacattcctccagatcaatatatatagatctatctctctgactttaaatgttagctttgactgaaaaagaaggcaaacacggcagctagttaacacagctctggcccttccagcattaacattcagtttctaggcactaactctagaggctatctaattttacattgatattaatttattttaaagataaaaatgaactctgtgagggtgttgtgaaatgaaatcaatgctgggcttttgaaaattcctgagattgagtagtgcttctctgcctgatcaatcacaaggatcctgtgaaaccttccactggactcctccctactccccatccccaatggctgagtagtgaagcttaccttgcttcaccctggaaagaaagatggaaagactgtgttgaaactaagatggttctgtcaaaagttgagaagaaagtttacaaactgaaaagcaggctccaaatgatcatttccatggaaatattcatggagatttcagaaaaagatacagtgccccatttataggatttgggttttcagttgaagagaggcagtggagtataactacttagagcacaagccctggggcaaaacttgttagattcagtccttccttctgccacttcttcactcaagttaccccctgcttaggtctcttcacctgtaaagtgtagcactcagttcgatcaggcaaacagaaactactctatagttatttcaggaaggcatttaacacagagaattaggggcctacaaagcctttggaagggctatgagagaaaaggtaagggaactaccagcaaaatgagacagttgtaggaattgcaggaatcatgggaaattttagagattgttaggaaactgctgctaatgacgtcactgaagcagatgtttcacaagagaatgctcagaaatcacttaaatcttttctgatcaagcccacacacctaaacaagacgtcaggaagagcagtgatggtgtctacttcccttctgcttgccaagtttcctgcaagtacctctcatgggtggaatccaaaactgaacttgactgacaaatgagtgtgggaaatgtagcttccaagcttaacaatataggtgagagctagaaaaagcagggatatgacttaacaatacaggtgagagctagaaaaagcagggatatgaatatgacttcataggttggttataagaatatatatatgattcaatttatgtaaaataaaacacttagaacaatgttagctgtcacgatggtgtccagattatctgcacctaagatgccaggaattgaagtgcctacttgctttttaaatagtgcatcctgaggctgctccttcaattgtccattcaagcattcatacatatagcatccactgaatacatatttatcagctgtctaccagatagtgggtactaagctcatcactagggatgcagtggtgaaggaaggatacttgttcccttccctcaaagagttcacctcaaaggtagagagacaaacatgtacacaggcaacattattttgtaaagctatatcttcctaattctcatgttggtaaagtgctttacaaactttacagtttattttattcttgaacacgtattacctcctatcctcaaaataatttaatgagataagcagatcagatgttgctataaatattattaatgtcatttacagatgacaaaaaatttagagaggcaataatattatcaaggtcaacagttagtaacaggattggggttggaatacaattctcctaatacctagattaatgatctttctgatgagagcctgatgcgttcatggagtccttggaagaggggtaggaagaaggcaagattgttgctgagcagagagaggaagacactgtaggttcagattgtctaggttcaaaatagctaggttctgacacttactagctatacgaccttgggcagctttctgcctcagtttcctcatctataacaggaagacaattataggactgacccttgtagggttcttaagaagattaaatcagttaatttatctaaaatgctgagaactgtggcttggccatggtaagccctcaataaacgttaactatttttatcattattactgaagttgttgttattattgaattcccaattgacgtaaaagtagttgacccccatctcactgatcaccttctccctctcctctttttctccactagtaatgtgcatagtaactgtttctggttaagtgtgaacagcaggtcaaacacttttacagtgcaacatcatgagagactgggaaaaaaacatgctcaggcgtcaggaagtctggattctagtctgggttctgccattagtgagctatggaactctgagtgtatcacttaacctctctggactgcatctgtcatacaggggaaaatatattccttagcctacctcacagaatggttgaaagatcaaatgagatcatagatgttagatgttaaaaagttaaaagcacattacaaatgctgcatgatggtattatcattatcctcagagttaatctctccatctccttctcacttacccttgacaaccactcactcactgaattttattgagtcttgttctgaaatatttccccaacccaacccctcttctctgtcctcaatgcgtctgtcctagttcactgctttatcaatgcttatcaggatgactgtaacacactcctaactatttttctctagcccagtattacttccttctaaactagccatccaatcactgtctccagagtgatttttctaaagggaaaatctcatcaatctcatcttgtcacttcaccccctctataatctcactcccagattagaaatttacagtggctccctattgcctacaggatatgtggcattaatgaagcctctgctagtctctccatcctcattatccacctcatcaccacagaccccacgctccaggaagacaatactttctttccctgaaccttttatgtagcagtgctgctatacacactgttctctctgcctgcagaaccctctccactttctatgcctgggaaaatctcagtcccccttcaagaacaaaatcaaatgtcatttcctcagtgaagccctcctcaaagctcattccaccttgtttaagcctaggtacattacgtaattccatttcctttgcttaatagcattttgcttgactcgcaatttgatacatttcgtgctgttttataataatgcttgttttggagtgtttatccttaattagatcataagcttactgagagcaggaattttgttttgttcatctctgtctccttagcatagttcctggcacagagtgcatgcataataagaattaattaaatgtaagtgctcacaaatgttgctcaaactatttgtggtaaaggacagttttttaaaaaatttccaagctgttgcaggctgatatttgataaaatatgataaacatgtcacagcaatatcaaatcactttgatagttactaaatgttcactctcaattgtgtccttatctcactgcaaacattttgagtagcactcaggtagactttttgcaaagatgccttgcttctgccccctaaaatctggataactaatttgggaattttaacaagcatacacataaaaataataaacaagtgtatcatatattcagagcacaaactgggcaagaaatcaataaataaaactattgtaattagatatatgtatagatgtaataaattaaccgggcagtgaatgaaagggtgcaggattatatttagacagcaacagtttgcatggtacctcaaaactaatctaggaaagctttaggaaaaattgggatttccagaacctactcaaatcaaagatggctgagatggagtgggggaagttggggaaaagtggagagaaagaggagacctccagtaaacactgtttgcagaattttatttacctaaatgcttaattgaaagttttcatagagtctcaatagatagtggccactacacccaccccattcatttattaccttctttttaattattatttcacttcatgttctaggatacatgtgcagaatgtgcaggtttgttacataggtatacatgtgccatggtggtttgctgcacctatcaaccagtcatctaggttttaagccccacatgcattaggtatttgtcctaatgctctccctccacttgctgcccaccccccgacaggccccggtatatgttgttcccttccctgtgtccatgtgttctcatcgttcaactcccacttatgagtgagaacatgtggtgtttggttttctgtttctgtgttagtttgttgagaacactcattaccttcttgagccatgttgagaatgctctcaagaaacaggggactgggctggagccaagatggccgaataggaacagctctggtctacagctcccagtgtgagcgacgcagaagacgggtgatttctgcatttccatctgaggtaccgggtgcatctcactagggagtgccagacagtgggtgcaggacagtgggtgcagcgcaccgtccatgagccgaagcagggcgaggcattgcctcactcaggaagtggaaggggtcagggagttccctttcctagtcaaagaaagaggtgacagatggcacctggaaaatcgggtcactcccaccccaatactgcgcttttccgacgggcttaaaaaatggtgcaccaggagattatatcccgcacatggcttggagggtcctacgcccacggagtctcgctgattgctagcacagcagtctgagatcaaactgcaaggcggcagcgaggctgggggaggggtgcccgccattgcccaggcttgcttcggtaaacaaagcagctgggaagctcgaactgggtggagcccaccacagctcaaggaggcctgcctgcctctgtaggctccacctctgggggcagggcacagacaaacaaaaagagagcagtaacctctgcagacttaaatgtccccgtctgacagctttgaagagagcaatggttctcccagcatgcagctggagatctgagaaggggcagactgcctcctcaagtgggtccctgacccctgacccctgagcagcctaactaggaggcaccccccagtaggggcagactaacacctcacacggccgggtactcctgagacaaaacttccagaggaatgatcagacagcagcattcgcggttcatgaaaatccactgttctacagccaccgctgctggtacccaggcaaacagggtctggaggggacctctagcaaactccaacagacctgcagctgagggtcctgtctgttagaaggaaaactaacaaacagaaaggacatccacaccaaaagcccatctgtacatcaccatcatcaaagaccaaaagtagataaaaccactaagatggggaaaaaacagaaactctagaaaaactggaaactctaaaaagcagagcgcctctcctcctccaaaggaacgcagttcctcaccagcaacggaacaaagctggacggagaatgactttgacgagctgagagaagaaggcttcagacgatcaaattactccgagctacgggaggacattcaaaccaaaggcaaagaagttgaaaactttgaaaaaaacttagaagaatgtacaactagaataaccaatacagagaagtgcttaaaggagctgatggagctgaaaaccaaggctcgagaactacgtgaagaatgcagaagcctcaggagccaatgcgatcaactggaagaaacggtaccagtgatggaagatcaaatgaatgaaacgaagcgagaagggaagtttagagaaaatagaataaaaagaaatgagcaaagcctccaagaaatatgggactatgtgaaaagaccaaatctacgtctgattggtgtacctgaaagtgacagggagaatggaaccaagttggaaaacactctgcaagatattatccaggagaacttccccaatctagcaaggcaggccaacattcagattcaggaaatacacagaatgccacaaagatactccttgagaagagcaactccaagacacataactgtcagattcaccaaagttgaaatgaaggaaaaaacgttaagggcagccagagagaaaggttgggttacccacaaagggaagcccatcagactaacagcagatctcttggcagaaactctacaagccagaagagagtgggggccaatattcaacattcttaaacaaaagaattttcaacccagaatttcatatccagccaaactaagcttcataagtgaaggagaaataaaatacttaacagacaagcaaatgctgagagattttgtcaccaccaggcctgccctaaaagagctcctgaaggaagcactaaacatggaaagaaacaaccggtaccagccactgcaaaatcatgccaaattgtaaagaccatcaagactaggaagaaactgcatcaactaacgagcaaaatcaccagctaacatcataatgacaggatcaaattcacacataacaatattaacttaaatgtaaatggactaaatgctcctattaaaagaaacagactggcaaattggatgaagagtcaagacgatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattattaatgggggactttaacaccccactgtcaacattagacagatcaacaagacagaaagtcaacaaggatacccaggaattgaactcagctctgcaccaagcggacctaatagacatctagagaactctccaccccaaatcaacagaatatacatttttttcagcaccacaccacacctattccaaaattgaccatatagttggaagtaaagttctcctcagcaaatgtaaaagatcagaaattataacaaactgtctctcagaccacagtgcaatcaaactagaactcaggattaagaaactccctcaaaaccactcaactacatggaaactgaacaacctgctcctgaatgactgctgggtacataatgaaatgaaggtagaaataaagatgttctttgaaaccaacgagaaaaaagacacaacataccagaatctctgggacacattcaaagcagtgtgtagagggaaatttatagcactaaatacccacaagagaaagcaggaaagatccaaaattgacaccctaacatcacaattaaaagaactagaaaaacaagagcaaacacattcaaaagctagcagaacacaagaaataactaaaatcagagcagaactgaaggaaatagagaccaaaaaaacccttcaaaaaatcaatgaatccaggagctggttttttgaaaggatcaagaaaattgatagactgctagcaagactaataaagaagaaaagagaaaagaatcaaatagacacaataaaaaatgataaaggggatatcaccaccaatcccaagaaatacaaactaccatcagagaatactacaaacacctctacgcaaataaactagaaaatctagaagaaatggataaattcctcgacacatacaccctcccaagactgaaccaggaagaagttgactctctgaatagaccaataacgggagttgaaattgtggcaataatcaatagcttaccaaccaaaaagagtccaggaccagatggattcacagccgaattctaccagaggtacaaggaggaactggtatcattccttctgaaactattccaatcaatagaaaaagagggaatcctccctaactcattttctgaggccaggatcatcctgataccaaagccgggcagagacacaacaaaaaaacagaattttagaccaatatccttgaagaacattgatgcaaaaatcctcaataaaacgctggcaaaccgaatccagcagcacatcgaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaacacctttgacaaaattcaacaacgcttcatgctaaaaactctcaataaattaggtattgatgggacctatctcaaaataatgagagctatctgtgacaaacccacagccaatatcatactgaatgggcaaaaactggaagcattccctttgaaaactggcacaacacagggatgccctctctcaccactcctattcaacatagtgttggaagttctggccagggcaattaggcaggagaaggaaataaagggtattcaattaggaaaagaggaagtcaaattgtccctgtttgcagatgacatgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttggacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggtaacctacaaaatgggagaaaattttcacaacctactcatctgacaaagggctaatatccagagtgtacaatgaactcaaacaaatttacaagaaaaaaacaaccccatcaaaaagtgggcgaaggatatgaacagacacttctcaaaagaagacatttatgcaatcaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaacaggaacacttttacactgttggtgggactgtaaactagttcaacccttgtggaagtcagtgtggcaattcctcggggatctagaactagcaataccatttgacccagccatcccattactgggtatatacccaaagggctataaatcatgctgctataaagacacatgcacacgtatgtttattgcggcactattcacaatagcaaagacttggaaccagcccaaatgtccaataatgatagactggattaagaaaatgtggcacatatacaccatggaatactatgcagccataaaaaatgatgagttcgtgtcctttgtagggacatggatgaaattggaaatcatcattctcagtaaactatcgcaagaacgaaaaaccaaacaccgcatgttctcactcataggtgggaattgaacaatgagaacacatggacacaggaagggtaacatcacactctggggactgttgtggggtggggggaggggggagggatagatttaggagatatacctaatgctaaatgacgagttaatgggtgcagcacaccagcatggcacatgtatacatatgtaactaacctgcacattgtgcacatgtaccctaaaacttaaagtataataataacaaaaaaaaaaagaaaaaaaagaaacagggtactcagtaattatcctaggaatggccctactccttggtaactcaagagcagaaacggagttaacaatgttagtcaaaagtttcatcatatagtcagtaatgaagccttggaattagtgagcaaaagctacatgtaatttaatgacataaaaataacactcccaaatgaatatacaccttcaactcagtagtgggaattagttgccttttagggacctggtgcctgaagtctcttcagtgaaactgcttcattgaagccacaatgaataaactcagaaggtagcatcagaaaatgtttaagattgtcctcgccttccattgttcatattttggacccattggttcctaaaatgctgagcaaaatcaagacacaattcactgtaaaagcaagtgaagaatcgtatgccctggcaagaaggaaagaagccatatttgtttcttggaacaaatcagcatgaatatgtggaatggtcagtcttgacatggatctcccacgatgcaactgcaattcactccccttgaaagactctaacacctcagtgagctgacaatgttgcaatatacaaagggctatattaacacaactcttagagagcttagtagatttcgtcatatttatttattttgctttttgctattcagttgagtacaatacattcaattccaaaaatatttggtgacttcctgctatgtgccaggaagtgagccacgtactagagttacagaaatcaataaaatgtaggttctgctttcagagggcttataatataatctgaccatagtgccttgtttgtatcctcatttattcttctttctgccctccagaaaagaaagacaaccaaggtgttcactttctcatgagcgatacttcctaagtggggcctcattttaatataataatagataatacatatatagcactaaaattctatgatatatatactgcaattatcccaattttacaaccgaggaaactaaggtataaacaagtgaaacaaactaccaatgtcacatagtgtatcagtgatggatccaggattcaaacacagctgcggaatccattttcttaaccaccactctatactgcatgatatggataatagaaattcctgcctgtaagcactatccctttcataaagtatagtttgtgcttttgggagctttctgaggagctcagggaaaaaggatgatactccacatgtcccttaattttaatattgaaaatgaatcgaatcctcctgggaagcacactcttgtcttgcatggtaggtgggacgaggaatgcctgttttgagaaacctgtgtgaagaaaagccatgaagtgtacccaaaatatttctaaaatttaaaaagctgtgaatttatgtgtgggtatctctacatatgtctagttagtttagaaagattgtggctctcacagtgctaaaacactgaattattcaataaaaaaaatatatggttagtctggtgagatgcatttaaatcatatatatacaaaaatgtgttattttcccactatttatgctggcctttttttagtttgttttgcgatctttagggctataagatgatgaggactgtaagcctaactaaggctttatggttaaatatgtcgtcattctagtatgaaactttagtaccccttgaaaaagtatgtaccctgaaagtcccattcttgtaacactatttggaaaccagagttgtgatgtctaatgcacaaaggccagatcagctgacttttgtctcagtttcagtctaataactctatttcaagaaccattttcccttcatatttattctgttttctgattccaaacctgggaatatctacagaacaaaaaggagcattctacttctcattaaaggacaccaaggctctccttgtaggatgactctgtaatgagtagaaacaacttcagttagatgttgcacagcagttaagtagtgtttttcagattgcctggccttggttcttgattcctattcagagtctccttgttctgcatcaaattttattgaggatcctgttacaatctattactttacttcctgaattacttgtccataaaggtcttctgccttctgaggcttggtgtatgtcttgagtagagaatccaaaaagattatctatgccattaacctggatgatacttcctgctgcccagctcctaagacaaacctttccatccacagcctgctctcaccaaaacctgatacttgcctcatgagtctctgtaactatataccataaagacccaatattctgatttgtgactagaacttgatggatggatattacagaatatccaggaaaaaaaatcttgacttcaataatgagctggtctgtgataggattcatacttaataaaaccagaccaaacaaagtaaataaaaatttggatggatgaaaaggtgtaaagacactttgtttctggccgggtgcagtggcttacacctgtaatcccagcactttggaaggccaaggtgggcggatcaactgaggtcaggagttcaagaccagcctggccaacatggcgaaaccccaacatgtaattttagtctctactaaaaatacaaaaattagccatgcatggtggcacatgcctgtaatcccagctacatgggaggctgaggcaggagaattgcttgaactggggaggcggaggttgcagtgagctgagatcgtgccattgcactccagcctgggtgacaaagtgacactccgtttcaaaaaaaaaaaacactttgtttctgtttctaaaataatcttcatttcctcacttcactacaccaccttccctccatgcaaagggcaaactgtaggattttaaaaaggcaaagcattgaagtttatttctgagctacaaggcattcataaaactgaaaaacatgagatcctgtttcttatcatagacttttcaccctcgaacatttattttctccagccaatttaatgcactttcagtcaaatcaatttcttgacattaggtaagacagaagagtcaaataactggcactgattcattccacaaacatgtattaaacccatattttgtgccaggcactgtgtgaggtgatggaaataagccagtgcacaggacagtcggggcttcttctgtcccaaagtttataatttagtaagaatacagaaattaaatgttacatcaatacataaatacaaacagtgataagggccatgcaggacaagttcagggtgcgatgaacaattgtaacaaaaagatctgattttgatttcaaagaaggggtggtgttaaagaagacttttcttaaaaacttcattttcaacagaaaaccaaacgctgcatgttctcactcataagtgggagttgaacaatgagaacacatggacacagggaggggaacaacacacactggggcctgtcagggtgtgggggttgaggggagggagagcatcaggacaaatagctaatgtgtgcagggcttaaaaccctatcaaaccatgacgggttgacaagtacagacgtatacctatgtaacaaacctgcacattctgcacatgtatcccagaacttaaagttaaaaaaaaaggcccttttaagctgagatataatatcaaggattattaagagttcacaaagcaaaaaaagagtaggaagaatatttccagcacagagaacacaatgtgcaaaagtcctgaaatgtgaacaagcttggagtgcctcataaagacagtatggctggaacacgatgagaaaagacagtgcaagataaggttggggtcagatcatttagagtcttgtaggttttggtaataagttagattttattctaagtacaattagaagccctcaagtgggttttaagcatagacaggatatggttgtaattgtgtttatttgttaaagttgattctggctgctctgtggaaaatagactatagagaggcatgaatggaagtagggagatctattaggcaactcatctattagtacagatgagagataatggtggctctgactacataagcattataggtagatttgaaatatacgtaggaggaagagccaattggacttggtgactgattggatattcagggtaaggaagaagtgagagtgaactgggcacacattttatgtcatggatgtgaatcagctaaagacaaatatccatagtgggaaaggataattagcaattctgtgattcgggaatctgattacatttgaacaataagatagcaccttttctttaagaggagtgttcaaaagtaaagtccaacctccctcattttaaagatgaagaaattaagactcataatggatgtgctacttagcaaattaatcttatgctgtatatgaatgttttatctcccaaattaaaacataaagatccaaatgacattacttgttttgtagacatctcttcctaatagcacccaatatagagattgaggatatagcaaatactcaataattgcctctcaaattaaaatgaattgaattccttcttctttctcggcagatagaacaaaatggatattctggttattgataatggcagtgaagtgacagagttcatcctggtgggtttgtacaaccatccaaaatttcagattgccttttatcgcaccatggtagtggtctacctgatcacatttgttggtagcagtctcattattgttgtggttaaagttgatgggtggcttcacactcctatgtgttttttcctaagcaacctgtccttccttgatatctgctactccagcaattcagtaccttttttgttgttcaatggcttaagagactaccccaccatttcctataacagctgttatgcccagatgaccagtgctttttttctggggatgacagggtgtcttctccttgctgtcatggcttatgagagatttgttgtgatctccaatcccctgcgctacatcatcattatgaacaataaggtctgcatacagttggccatggtgacctgggccagtgccttccttatgtcattaatacaataattgcaataatacattgcaataatacattaattgcaatgattgcattgcaattcctgcccatttttgtggacacaatgtcatcaaccattttacctgtgaggtgcaggaattgttgaagcttgtctgctcagacatcccaggcagcctcatcctcggtctagtcatcggcatattcaccttgtccctgcccttcaccttgcccctgcccttcaccttcatcctcttcgcctatgctcacattgtggttgctgtgctgaggatcaactctgcagaggccagactcaaagctttctccacctgtggatcccatctgactgtgatcatcatattttatgggacagccacctacatgtacttgaaacctcagtcaagggaatcccaagatgagggtaaagtcatctctgtattttttttgaaagtattttttattatactttaagttctggggtacatgtgcagaacgtgtagttttgttacataggtatacacatgccagagaagcaacatcaaaatgatagcatctctgtattttatggtgttgtgacccctatgttgaaccccctcatttacaccttgagagacaaggatgcgaaaatgctctaagaaaaataattaggaagaaagagtcctaaaagaatgtgaatatcgcatggaggctcatctaaccaacagtttgatattgacttgtaaaaataacaaggtagaaatactaaacaacattttataagataattaaagtgttttctctatttccaacaggcatgtaaaatctttccactgagaaaaaaaatgttaaacttttatagtaccaccatttaagtagtacacagggcagccttgaaggagagttttaaaataaaataataattagtacattgtaatcctgagcagtttgattttattttactaaattggaaatattctattataatataataataatatgctgagattcccttttttaggtgaaaaagagcaaagttgcaaaatcgacaattcttatctcaatgtttttggtgtaaaatgtgtcataacccacactttgaagtgatggaggtgagtagagagaaaaaaattacttaactactacataagtgtctgcatagaaggtcctctgctaaagcaaggaggccttcaagactgtgaacctactgagaactagaactgatagacattatggaaaatgcaattacatgtcttgatcagtagatagggctatattttctctatgagtgtgcactattccttccaacttccaaaggtgatctaaaggtgttgaccttacaaacacagcaaatttaactcaggaggaatgtcttttaaaaagcaaatatatacagtatttttaaattataatgttaattatttaaaagtagataaaacggtagagaataaatttaaaaatcacctataattccaacactcaatgaggcttgcatcagtttggggttcagatatgcatgtatttaagtctgctatgcacaattatttcagattcagctcatcactttccatatttacacctcagttttctcatctataaaatggggattataagagtgcctacctcacaaaagtggttttgaaaattaaatgtgataatacaagtcacatttctatcacaatgtctagcatatggtggacattgaatatgtatcaaccaaaaaaatacctgtcaatttgccctttaaaatccacacccattgtatgagtggtcatttgcctatgtctataccaataatgactgtatcatttaaaaatattccatgacaatatgacagactgaaaatttgtgtttattatcttattatctttgaggttgggtcaaaatgtcagtgagtcagcccaactctggaaaaaagaaaatactaaactcagtaacgtatgactaataaaagcttccaaacttgtttcaatctaattgactccaccattgcttctggatacatcctggcaggtacacccaaagttggatctattctatttcactctggtaagcactcctggaattaatactttatccatcaacaacagaagctgactgaagactattgtaagtgcaaacaaaaatgagaaaagcatgggaaccccaataaagaactctttggaaaagaaatctatggtgctatacaaattttgtcgtaacattatcaatttaatcctgaaaaaattctcatgtaagtttaatttctgatgttttctaatccttctcatctaacctaacgcaaccctgaaactagaaggaaggtactattaactaacaagaagacacagtgagcagatgaagtcaaacactagaggatggaaacaaatatgatttctcagatgtaagggggaaaaagggaggaaaactgcaagcctaatacttattagagtttgatcattttcattaggaactaagaggaggtagagaggaacaagaaatgagatgtgccttgtgctgacagagagaaatttatcggggagaggcagggacctttttagctgtgagagaaaattagacaggtaaactaatttctttccttttgattacctcaaggagaagttagacaagactctctctagagaaatgtgttacatctggaagtggagaacaagctacaggaagctttctaacatgaagtcaagactctggatgagtagaaaatgtaagaaattataagaacaactgttcagttatagttgaatgtgttaggtgcctttatattaaaagtttgctgtgaaatttgccttctccaaatcttccttgtattacaaaataaacaagtctgagtcataataaataagcaatactttagaactaccctaagccttgggaaatttgtttaaatttcttatctctgccaaacagcagttatgactcgtagctgataatggacaactctgcgtctctgcacaccatctcctcataaggtgtgccaaaatcacaaaacaacatcttagaaggttgaactgaccccttaaaaaatcaacatcgctgagaaaagagcttcgtgctgtgtactggcagcagcagagcaaacaaaatgcacttgagcaccataaccacaacttttccaggaagtatttcacagaaataaattttaaaatttgaaaaaaattaagaagaaatcattgaacttttagtgaatttgtcaacaatgtcagtactaagtagtaagaaaataaaattaattacctacagaatggtcctttggttttaacaagtcatgaaagcagaactagtcaatctaccattttcatcacgtagaaaggagtacatagaaaagtgctcatttgttcctgcaattttttgttgtcgttggctcaattaaaataatcatcaaataaagtttttcactaatgcatttgagtcatggccctgtatgcccatatctgcttgtccacatatatacatggacatatacacacaagctttattgtcagaaagacctgaacttgggcaatatattttaacccctctgaaaccctcattatcagctatgtagtatagaatataataacctctacttcatagtgctgcttatgagcataagataaacagtgtaaaacacttagtacagtacttggcaaatagtaagcaccttaaaatactttattacttttactattcccatttttattatttttaattgacataataattgtatatatttatgggatacagtgagtatgtgataatcaaataaggttaatttacatattcatcacttcaaacatttatcatttctttgtgttggaaacattcaaaatctgttcttctagctatttgaaaatatacaataaatattgttgatttcagtccctctttagtgctacagaacactagaacttattcctcttatctagctgtacctttgtacctgttgaccaaactttggctatcctctcttcctcaaacctttccccatctctagtaaccacaattctagtgtctactcgtatgagatcaacttttttgcatccacatgtgagtgaggacatgtggtatttattcttccgtgcctggctttttccattttgcataatgacctctaaactcatccatgttgttgtgaattacagaattttgttctttttatggctaaatagtattccattgtgtatctatgacacattttatttatctattcatattttgatggccacttaggttgattccatactttggctgttatgaatattgcttcaagaaaacatgggagtgtggatatctttatgaggtggtgatttcattctcttcgggtatatacccagaagtgagattgctggctcatacagtaattccatttctagttttgtaaggaatctttatactgttttccataatggctgttcttatcatcatcattagtattatataactctagtaccagagatgcccttatattgaaaggcttaatttattctatgtgtagcaaggttatcacacttttcttgactaaagctcatacagggaattatagagagcatatacaggcatgtgtgtgtgtcaggatgtaagtgttgaaggatgtttcacactttgcctctttttgcaccttacttcacttattcaaccaatatttattgaatatattctatgtgttaggtgatttgctagcactggggatctacaggaaaaaaagacaaatttcttgctatttgttagtagggactaaatgttttaaaatacagacattaagcaggctatcacatttataagcaaaacaatttgagagcataagaagtactctgaaggaaacaaacagaaagctggagcaaagagcaatgagtgagacttccttatgatagaattttcaggtaagagctctcaaaagaaattatatttaaactgagactgaaggattcacattaaatgcttagtacaaatattgaagagtgaggagatgagtatactagaatgaagggggaaaaaaatgtaaaggcctgaaagaaaggaagaactgagcatgtttaaggaacaggaagaagacaaataagtgtaagttatgtgagcaagggggtgggtaggtggtatgtcatccattccttcattcatccattcaacaaaaataacaactaaacacaaacacacaaataacatgtgtgcatgcgcacatgcactcacatagtacacagagacagaaagagaagccactatgtgtgccaagcactgttcttggctttgggaatacctcaacaaataaaaatgtctccagactaatgaagtggtatgttattgagaaagagacttaaaccataaatataaaccatatagtatttttttaaaataaaagcaatggtaagatatataaggagaaataggttaggagcttccattttaattaggataatttaaaatttcctacatatgtgaatatgtaggacaataatattccaggcaaaggcactaagacaaaagaatgaaaaatgtatttgaagaacaccagggaagccagtgtgattggagaggagggagcaaaatagaagaaagcatcagatgagctgagagaggaatggggaccagattgttcaggtacttctagaccattgtagggtacatcatgcaggtacttctagaccattgtaagggttttagtttgttttatttaaaaaaataaaaaagcttcattgagatataattcacataccataaaattcagtattttaaattgtacagtttagtgacatttagagcattcacaaagatgtgcaatcatgttataaatattatttgtctattcttcagttgcttgtccctatattttcagatataataagctttaggatataaatacagatgtgtttgcaaaactagaaaaaaagaggaattcacgccacagcaatagatgaagtttccaatttcttcacatcctagccaatgtttattattgtttgtcaagtttattagagccatcttagtgagtgaaaagtggtatctcattgtagttttgatgagcattttcctaacactaatggtgttgcatatattttcatgtgcttatttgccatttgtacatcttttttggagaaatgtctttgcatatcatttgcccatatttaattgggttatttttctttttattattgagctgtaagagctatttacatcctccaaatataaattccttatgggatatatgatttgcaaacattttgttccacttcatgggttgtcttttcaattttttggtaatgtcctttgaagcacaaagtttttaaatttgatgatgtccagtttgtgttccacttccttttgtggcttataattacgttgtcatatctaaaaaccattgcctagtctgatgtcacaaatatttatctctatattttcttttaagaattacaaaattttagctctttcagttaggtctttgatccattttgaattaacttttgtatatgatatgagataaggttcaaacctcatccccttgcatgagggaatgatgcagttctcccagtatcatctgctgaaaaaactattacttcccccatctacttgttttggcaccttgtcataccatatgtgcatatttatttttggatattcaactctacttcactcactaatatgtctgtctttaggccagtaccacacagctttggttaccctattcttttaataagttttggagtaggggattgtgactcctccaactttattcttatttttcaagatagttttggctgttttagatcccttgcattttatatcaatttttggtttcttgcatttctatatgaatgttgtaaattccaacagggaaatagatagagattgtgttgagtctggggatcaatttggtaagtattgctatcttaacaatattaagtcttctaagctatgaaaatggaaagtttttccatttacttaggtcttctttactttctttcaacaattttttgtagttttcattgtatgtatctttcacttcatgtgttaattttattcctattttatcctttttgacactattataaatgaaatcgttttcttagtttcatttgctggttgtttattgctggtgtatagaaataacagtgattgtgtatattgatcttgtatcccacaaccttgttgaatttattaattctaatagtttctgtggactctttatgatattccatatacaggatcatgacatctgtgaatagacctaattgtacttcttcctttccaatctggatgcttttatttctttttcttgcctaattgctctggcaaaaaattgtagtacaatgtcacaaaaaagtggcaaaagtagaaatgctggtcttcttgatctagagggaaagtcttcagtctttcaccactaagttgatgtcagctgtgtgtttgtctataataaaaatatttatcttaaagtctatttcatctaatattagtttaggtccaccagctctgttgtgggtgctttctacatactatatatttttccaaacttttattctcaatctatttgggcgtgtgaatctaaagtgagtttcttgcagatagcatatagttggatcatgttttaatattttttaatccctttggtcaatttctgtccttttatgtaattattaatgataggatttaaatatgccattttttcctttcttttctgtatgctttatatctcactttttcctgtatttctccattattatcttcttttgtgttagagagaaattttccagtatttcattttaattccaatattgtttattttatgatatttttgagctatatactcagtggttgcattagagattacaattaacatcttaacatatcacaatctactttggataagtaacacttaaattccaatagttatatataaacttagcttttatattactcagtttcttcctcattcctttgtcataatgatgtcagatggattttataaacccattaacacagatttgtaatgatttccttaggaaattgtcttttaaatcaggaaggagaagaaaatagttaaaaatcatttatacatttttattctatatttatgtatgcagtcattttaacagtgttttttatttcttcacatggatttgagttactgtctagtgttcttttatttcagcatgaaagacaccctttaatatttcttgtaagtcagggttgctggcaacaaattctgtcagtttctgattatctggaaaattttttattttctccttcattttccatctagcaaaggatagctctgctagatatagaattcttcattgacagcatctcttctgtatattttaaatttgttaatccactgccttctgggctacatgatttctgatgggaattcacttgttaatcttactgagaaacttttgtacatgatgagtcactcttcctcttgctgctattaaaattctctctttgctttggcttttgacatgttgattatgatttatctaggtgtggatctctttgaatttatcctactcaggaaatgttgagcttgttagatgtatacattaatgtgtttggtcttatctggagagttttcagccattatttctttaaatatactttttccttttatttcttcttttggaacttctattatgcatatattggtatgcctgatgatgtctcacaggtctctgagtttctgttcattttttttgttatttcttcctgtttctcagacagtatactctcaattaacacatattcaagttcatttattctgtcacctgctttctcaaatatgctattgagtctctcttataaattttctattttagttattctattttcaactccaaaacccctatatggttatttttaaattttctatcttgttattaatattggctattgggtgagatattgttattacatttttcttaattctttagactttttttatttctttgaacatatttgcaatagctaatttgtagtattatctggtaagtctaacatccgggcttcctttggaacatttcctgttgattgcttttgtttgtgtgtatagaacacactttcttattttggaggggctcataattttttgttgaaatatgtacattttaagtgatataatgtaaaattctggaattcaaattcctctcattcaccaggatttgttattacggtctattgcttttgttcttgcagctattttattgttagtgactttcatggattatttaaagtctgtattatttgtgctgttcaactactgaattgtctgcttggttagcttagtagtcagctaatgactggacagagatttaattaaatgtcttgaactaataagtctcctagccgtgacagaggggctctgtttgcatattgtggcacacattcaatgctctctcaggcagtttacaactccggcttaacctttataccctgcttgcagagcttcaaagtgaacgacaggcaagaaataggatcttctcagggctttcctggacattcacatagtctacatgtgtccatgtgtggctttctagatcctatgagtgtgctaaaacttttcaaagctctttatggccatctcgtccaccagtttttctttttaagtattttagtcagtcttttgttagtaccaactggtaacaacacctcaagtagctgccctgttaaacaacttccactgattcttttggcaaatgtcctgggaaaagggttatttacacagtgacttattagtcagctcaaataaaaagaaccccagaaaatgtgcttttcaacaatctattagaaaagtcaaatcgtggcaattctgtggggaggtggttttggggaaaattcaaacctgttataccctctcccatggtggctaagcttctggttttcatggctgctatcattgtgaggctgttgattttcaaagctatcatggatttagggagaacaaatgggattcgggcaaattaaaacaccatgaaggccacttctcattaagatgatgttttctttcttgaataaatgcttcttagattattgtaaatttttgattaatttccagagttctaaaaaaatttgctttgacaattgttgtcagtgtttctattacttttatagagaaggagatttttggagttacttacgtcccattttggaggttcttctcaaaggctttaacttttactttgaaggaaatggtaggtttttaaaggtatttgagaagtggagtatcctgattcaacttacattttaaaagggttactctgactattgtatgaagaatcaactttaatgggtcaagggcagaggcatagagactacttagaagaatatttcaacagcttaagtgaaagttgatggtggcctagaacaaggtggtaataaaaagtggtgggaagtgacaggattttgaaaataatttgaaggaagagtcactaagatttaatgatggattggatcaggttgtgaaaaaaaagagtcaaagatgactcaaatgtttgtgttctaaataactggaatagagaatggacataatgaagatggggctatcagaaaatattttggagagaggaggtacgaagacagagtgagagttaaatttttcacgttaattttgagatatccattaaaccaaaaaagaagcaatgttagttaagaatttgattatttgagtctgcatttcaggggagagatgtgaattggaaatatgaatatgaaaattgtcaacatatagagtatatttaaagccacaggactggatgaggtcactaagggataagtagctagaaaagacaaaaagtccaagaactgaggcctgaggaattccaatcttaggaggttatggagaaaaaacaaccttaaaagaatactgaaatggaggggctagttagcgtaggtaaatcaggagagtgtattgttttgcaaaacaaagggtatgaagaagagtgatcaaatctctcaaatgctgccattaggccaagtaagggaagaacagaaaattgaccagataaactagcatttcctatgaagtaaaataggcataaacatcatattgtgttttgttaacaggttactgagaggctaagtgagattacatggctgtcccccatcctgagatagagttatataatatgtggggagctgcagataactttgacatcttctatttttgcttgcaaacacatctgcacattttattctgtgagatgtgtcatgaaaagtttatttttttctcttttgaatgtttttttaaaagagaaccaatttgaggtctggcaatggcagagtggcttgttttggacaatcatctcacagatttacaaaactctgtacaaaatattaaaaatgagctacagtcaactgctgcataccaatgtttcggtcaacctgactgaatatataatcgttgtcctataagattataatgacactgaaaaatgtcagtgatatcagagctgtcatgatgtagtgcaacagattactcacatagtcatggtgatgtataaacaaatcttctgcactaacagtcatataaaagtcaagcacatacaattatgtgtagtacataatacttgttaataataataaatgactatgttactgatttatgtatttactatactatacttaattatcattattttacaatgtactccttctatttatctttgtaagttaactgtaaaacagcctcaggtagatccttcaggaggtattccagaagacattattttcataagacacgacaacttcatgcatggtattgcctctgaagaccttccagttgtccagcgggacaagatgtggaagtgaagatggtgatattgatgatcctaaccctgtataggcctaagctaatgtgtgtttgtttgtatcttatttttttaacaacaaagtttaaagagattttttaaaaattaggtagaaaaaaactcataaaataaaaatataaagaaaatattttgtacagttgtacaatgtgtttgtattttaagctgtgttatgagtcaaaaagtctaaaacatttgaaaagtttataaagtagaaaagttacaccaaattaagtttgatttactattgaagaaataaattttaaataaatttagtatactctaagtgtacagtgtctataaagtctgcagtagtaaacagtaataccctaggccttcacattcactcaaaactcagtcacagactcacccagagcaatttccagtcctacaagctccatttatggtaagtgccctatacaaatataccatttttaaacttttatgccatattttactgtaccatgtctatgtttagatatgttcgtatgattaccattgtgttacaattgcctacagtattcagtagagtaacatcctgtacaggtttgtagcctaggaacaataggcagtatcacatagcctaggtgtgtagtaggctataccatctaggtttgtgtaagtacactctatgatgttggcacaacaaaaaaatcgcctaatgatgcatttctcaaaatatacccccaatgttaagtgacctatgattgtatttgaaggtactggagagcacccgaaagcagacagaaactggactgcattcaactgctaatagaaagaaaccacactgagtaaggtccatatctatgtagttttctcctaagggcactacccaggaaatttgatgtgaggtacctagaacgcaaggagaaatctcaagtcatattggtttgaggtattagaaaatgggattgggacttgccagagcagctaaaaattgaagaggaaaatcccagaaaggggagtgtcacagagaagtgagttctaatttttatgtaaaataccctaacacaaatatgtacagaaaaaacaataagaaagcttacagaaagcaacagaaataaggcaaaaaaaaaaactgaaacagatatttcagtgtttgctcaccatagggagacagagcctagtgtgaattccattaatttaggagaccttgataaatatcttaattgaaacagggtcttgctctgtcacccagtctggagtgcagtggcatagtcagagctcactgcagtctcaaacttccaagctcaagtgatcctcgcacctcagcctcctgagtagctgggaccacaggcaagcgccaccatgcccgactaatttttgtattttttgtagagatgggattttgccatgttgcccaggttggtctccaactcctggaccaaagggatcctcctgcctttgcctcccaaagtgcagggattaaacaggcataagccactgcgcccagcctataaatgtattagactttctgttaaaattctggaaagaccataccttaagaataaggactatctccaaaggttaaggatcccctgtaagcaaaactagtcagatccagactaacaaagtatcaaatgaaggctccaaaagtttaagataatcagcctatgatttaaaagtcagctggagtgaaaatcaaaacactcttagaagaaaatataagaatcaataatctctaaaaaatattatcaagtttccactacgcaaccaaatatcactagagatgaattttcaaaaacataaaatcataagaaaaaagttaatacaatgaatctgtaataatccagatgttaaattagcagatgacattttaaaagctattataaatatgttcaagaactttaaaaagataaggtggtcaaaacaggtggacaaatgggtataccaacagataaatcaaaattataaaaaagaccaaatggaaattctaggactacaacctatgacatttaacatgaaaactggctggcagataacagggggaaaaaattggtagtaaacttggagacagagtgatacaaattatcctatgtgggaaaaaagtaaagaagattttttaaaacataattaaccacattgactgaattcacatttctaaaacactgctgggtcataaaatatgtcttaaaaatttcaaatatggaaatctaaataatatgttttctgaccacaaaggaaataaaattagaaatgaacagcagtagaacatctcaaaaaaactcacatatttggaatttaaatcacatactaataagtaacacatgaagaactcacaagaaagattagagaatacttcaaacaatgaaaatgaaaatacaatacaaaaatttgtaggatacagctaaaacagtgcctcgaagaatatttatcactttaaatgctcatgtttaaaaagaagaaaggtttaaaatcaattatctacatttcaactgtagaaaagtaggaagagacaagcagattaaacccagtatgaaaagaagggaagaaataatctaaataagaatagatacacataaacaagaaaacacaaaatgagtaaagctaaaagtgtgttcttttaacatatttattaaatggttaaatcacaagcaaatctgattgattaggggaaaaagagacagagatgactttcacttttggtaatagctgagtaagatcttactagaccaacactcctgcaagtaacagctacaaattccagacataatacaaaatacagccaactggagacactggggagaaaatagaaaagaacagaatctaatgaagaggctatacttggaagagaggagttgcacaaaatgagttcccattttcatggttttagcttaaggctatgtgtaggtagcaaggtgggcagagtggtagtggttgggggaaggcagtctttctcttctggggatacagaaaactgaatctggagaaacaacagtgctgtagaaagagggaatatcccacaaggaaaacaccaagggaatgaatccctaaattctgtctgaccatatgtttgggtgatgctgaatcacgcagcaggtttaaagaagttcagttgaatataaaagatatgaaataagactgaagattccacccaaaaagcagattttgcagtctgaatataactgacataattgccagttaaaacaaaagaaacgctcatcagaaaaaagtaacagaatttatatactctacaatttaacatttatcatgtctgtgatgcaatcgaaaatcattcaacgtataaagaaacaggaaaatgttatacattctcaatacaaaagaaaatcaactaatactcatcactagctgacacaaataacagaattggcagacgtattttaaagcatttttctagctattcttagtgaagtaaaaaaaaaaatacagtcatgcatcgcataatgacgtttcagaaaacaacaaactgcatacatgatggtggtcccataagattataatggagctatataatggggtaggctataccatctaggtttgtgcaggtacactctgatgtttgcacaataaggaaatgcctgacaacacatttctcagaatgtatctccatcataaatggcgtaggactatatttgaaatgaatgtaaagacagaaaatctcgccaagaaaaaaaaagaaacaaagaaaaaaaagcctaaatggaattacataactgaaaatacaatctctgaaattaaatacactggacttacttaaaagcagaatggaggagccaagatggccgaataggaacagctgcgatctacagctcccagcgtgagcgacgcagaagacgggtgatttctgcatttccatctgaggtaccgggttcatctcactagggagtgccagacagtgggcgcaggtcagtgggtgcgcgcaccgtccgcgagccgaagcagggcgaggcattgcctcactcgggaagcgcaaggggtcagggagttcccattcctagtcaaagaaaggggtgacagacgcacctggaaaatcgggtcactcccacccgaatactgcgcttttccgacgggcttaaaaaacggcgcaccacgagattatatcccacacctggctcggagggtcctacgcccacggagtctcgctgattgctagcacagcagtctgagatcaaactgcaaggcggcagcgaggctgggggaggggcgcccgccattgcccaggcttgattaggtaaacgaagcagctgggaaactccaactgggtggagcccaccacagctcaaggaggcctgcattcctctgtaggctccacctttgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtactccaacagacctgcagctgagggtcctgtctgttagaaggaaaactaacaaacagaaaggacatccacaccaaaaacccatctgtacatcaccatcatcaaagaccaaaagtagataaaaccactaagatggggaaaaaacagaacagaaaaactggaaactctaaaaagcagagcgcctctcctcctccaaaggaacgcagttcctcaccagcaacagaacaaagctggacagagaatgactttgacgagctgagagaagaaggcttcagacgatcaaattactctgagctatgggaggacattcaaaccaaaggcaaagaagttgaaaactttgaaaaaaatttagaagaatgtataactagaattaccaatacagagaagtgcttaaaggagctgatggagctgaaaaccaaggctcgagaactacgtgaagaatgcagaagcctcaggagccgatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaacgttcagattcaggaaatacacagaatgccacaaagatactccttgagaagagcaactccaagacacataattgtcagattcaccaaagttgaaatgaaggaaaaaatgttaagggaccagagagagagaccagccaggaaaaaatgttaagggaccagccagagagaaaggtcgggttaccctcaaagggaagcccatcagactaacagcggatctcttgacagaaaccctacaagccagaagagagtgggggccaatattcaacattcttaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcgctaaacatggaaaggaacaaccggtaccagccactgcaaaatcctgccaaaatgtaaagaccatcgagactaggaagaaactgcatcaactaatgagcaaaatgaccagctaatatcatcatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaagggcaggggttgcaatcctagtctctgataaaacagactttaaaccaacaaagatcaaaagagacaaagaaggccattacataatggtaaagggatcaattcaacaagaagagctaactatcttaaatatatatgcacctaatacaggagcacccagattcataaagcaagtcctgagtgacctacaaagagacttagactcccacacattaataatgggagactttaacaccccactgtcaacattagacagatcaatgagacagaaagtcaacaaggatacccaggaattgaactcagctctgcaccaagcggacctaatagacatctagagaactctccaccccaaatcaacagaatatacatttttttcagcaccacaccacacctattccaaaattgaccacatagttggaagtaaacctctcctcagcaaatgtaaaagaacagaaatcataacaaactatctctgaccacagtgcaatcaaactagaatgcaggattaagaatctcactcaaaaccgctcaactacatggaaactgaacaacctgctcctgaatgactactgggtacataacgaaatgaaggcagaaataaacatgttctttgaaaccaacgagaaaaaagacacaacatgccagaatctctgggacgcattcaaagcagtgtgtagagggaaatttatagcactaaatgcccacaagagaaagcaggaaagatccaaaattgacaccctaacatcacaattaaaagaactagaaaaacaagagcaaacacattcaaaagctagcataaggcaagaaataactaaaatcagagcagaactgaaggaaatagagacacagaaaacccttcaaaaaattaatgaatccaggagctggttttttgaaaggatcaacaaaatagatagaccgctatcaagactaataaagaaaaaaagagagaagaatcaaatagacgcaataaaaaatgataaaggggatatcaccactgatcccatagaaatacaaactaccatcagagaatactacaaacacctctacgcaaataaactagaaaatctagaagaaatggataaattccttgacacatacactctcccaagactaaaccaggaagaggttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaacaaaaaagagaattttacaccaatatctttgatgaacattgatgcagaaatcctcaataaaatactggcaaaacgaatccagcagcacatcaaaaagcttatccaccatgatcaagtgggcttcatccctgggaagcaaggctggttcaatatacacaaatcaataaatgtaatccagcatataaacagagccaaagacaaaaaccacatgattatctcaatagatgcagaaaaggcctttcacaaaattcaacaactcttcatgctaaaaactctcaataaattaggtattgatgggacctatctcaaaataataagagctatctgtgacaaacccacagccaatatcatactgaatgggcaaaaactggagaagcattccctttgaaaatgggcacaagacagggatgccctctctcaccactcctattcaacatagtgttggaagttctggccagggcaattaggcaggagaaggaaataaagggtattcaattaggaaaagaggaagtcaaattgtccttgtttgcagacgacatgattgtatatctagaaaaccccattgtctcagcccaaaatctccttaagctgataagcaacttcagcaaactctcaggatacaaaatcaatgtacaaaaatcacaagcattcttatacaccaacagaagacaaacagagagccaaatcatgagtgaactcccattcacaattgcttcaaagagaataaaatacctaggatgtgaaggacctcttcaaggagaactacaaaccactgctcaaggaaataaaagaggatacaaacaaatggaagaacattccatgctcatgggtaggcagaatcaatatcatgaaaatggccatactgcccaaggtaatttacagattcaatgccatccccatcaagctaccaatgcctttcttcacagaattggaaaaaactattttaaagttcatatggaaccaaaaaagagcccgcattgccaagtcagtcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacattcgacctaaaaccataaaaaccctagaagaaaacctaggcaataccattcaggacataggcatgggcaaggacttcatgtctaaaacaccaaaagcaaaaagcaatggcagcaaaagacaaaattgacaagtgggatctaattaaactaaagagcttctgtacagcaaaagaaactaccatcagagtgaacaggcaacctacaaaatgggagaaaatttttgcaacctactcatctgacaaagggctaatatccagaatctacaatgaacttaaacaaatttacaagaaaaaaacaaccccatcaaaaagtgggcaaaggatatgaacagacacttctcaaaagaagacatttatgcagccaaaaaaacacatgaaaaaatgctcatcatcactggccatcacagaaatgcaaatcaaaaccacaatgagataccatctcacaccagttagaatggcaatcattaaaaagtcaggaaacaacaggtgctggagaggatgtggagaaacaggaacacttttacactgttggtgggactgtaaactagttcaaccattgtggaagtcagtgtggcaattcctcagggatctagaactagaaataccatttgacccagccatcccattactgggtatatacccaaaggactataaatcatgctgctataaagacacatgcacatgtatgtttattgcggcactattcacaatagcaaagtcttggaaccaacccaaatgtccaacaatgatagactggattaagaaaatgtggcacatatacaccacggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtggggtgggggggaggggggagggatagctttgggagatatacctaatgctagatgacgagttagtgggtgcagcgcaccagcatggcacatgtatacatatgtaactaacctgcacaatgtgcacatgtaccctaaaacttaaagtataataaaaaaaaaaagcagaatggaggtaacagatgaaaggttaatttaacttgacgactgaccaatggaaacaacacagaaaaaaaaaaatcactggttaaagaatgtataaagcctcagtaaccagttagagaatacgcaacagtctaacataagtgtaactgtaatcccaaaataataaaagacagaaaatgggagagaaaaatagttgaagataaagtggctgaaatttcccaaattgaaacaaaagcataaattttacaaatttaagatgtccaaatcatcaagtaaagtaagcatgaaaaaggccattccaaggcaaatcatagtcaaattattgtcatccaaggataaagaccaaatctcaagagcagtaagagacaagcaatattatatgtatgtgtgtatatatgtatatatatatatatgaaataattatattaattctcatcagaaaatatagaggcaaaaattgagtagaagaatatctttaaagtactgaaagaataaagcaaaacattaacccagacttccacatgcagtgaaaatattctttaagaattaaagaaaaatagtgacatttcaagtaaaatgaaatagaagctacaaaatttgtcagttgcagaacgtcattataagaaatgataaaatgagttctttatgctgaaaggaaattttgacagatgaaaactgagattttcagaatagaataaaaagattgaatattatacatatctgaataagtatcaaaacattttttgctcttttcactgtaatttttttgtaattcatgcgattgctaaagtaaaaagtatggcattgtcttatgggattaatatcacatttaggtgtaataaatgtaacaataatagtataaagcaggggtaggcaaacttattgtataagggaccagataataaatattttaggctttgcaagtcacatggtatccctgtcacatgttctttgtttttgtgtttataatcctttaaaaacgtataaacattcttagctcaagaattatacaaaaactggttgcaagacagatttggcctataggccacagtttgctaacccctggcagatacccatatggaaaaccaaaatgaacctttactattacctcacatgatactcgaaaattaattgaagatagatcataaagcaaaagtatacactaaaactacaaagcttctagaagaaaatgtaggagaacatctttatgacactggcaatgacaaagatttcctggacagaacacaaaatgcactaatcatttaaacatggataaactaaactttatgaaatttaaaaatgcccttcgaaaacaccattcaggaaatgaaaacacaaatcagtaacaaaaaaaaattcacgatgtttatatttgacagaatattatatttggaatatataaaaactcttaaaaatcaataacaaaaagacaatccaataaaaataggcaaagacgagcatatactccacagaggaagaaatatgaattgacactatacacttgtactcagcattatttgtcatcagggaagagcaaagtaaaaccacattaggagggttgtttgtttgtttgttttgagatagggtcttgctctgtcacccaggctggagtgcagaggtgggatcatagctcactgtaacctcaaactcctgggctcaagccatcctcccacctcagcctcctgggtagctaggcctacaggctcatcccaccatgaccagctatttttttttaatttttgtggaaacaagttatcactctgtggcccaggctggaagggggtgatcttaagatgaaaagtgaatgagaactctctgtactatctttaaaatttttatctaaatctaaagttatttcaaaatagtttttaaaattatattctaccatatactcaccagaatactgaaataaaaaataccaacaacaccaaatattggcaaggacatggagcaaatggagctcgactttcctatgtcacaggtgggcatgtaaaattgtacaaacctcttcagaaaacatttgaaaacttcttaaaaattaagcctatgcctactctctgacccagcagctagtttcctagatattccccactaggaactaaaaacatttgtccacaaaatgacttgcacgtaaatgttcatagcaacaatattcaacatagccccaaatcaaaaataaccaagtgtggcatattcatacaatgaaatgttactcagtaataagaaacaataaataacgaatatatacaatgacacagataaatctcaaaaatgttatgttaagtaaaaaaaaaaagatagacacaaaaatgcatagtgtatgcttccatgcataagaagtgcaagaactggcaaaactaatctgggggaatagcaaacagaacagtggttgttgatgggtgtagagattgaccgggagaaaacacaagataacttttcagaattgtagtcatgttctatatctttactgaggttgtggttatatagttatatacatttttggaaattcatatattttacacttaagatatgtatatttcactatatgtaaatttcacttcaatattaaaaagacagaaaacataatctcaaggaggcaaaatggattcctcacagttgtattttaaatccatgcaggtgccttcagatctagattccactgtctcaacaaacacctttatactagataactgatactccaacaataaaaatgaacaattccatactcttagcacttcaagttcagtatcaaatgtatgaaagaccaactcactgtatctgtttctcttcttctttcttcagatgcagatctcagatatattttcaactacgaatagaatgtgagttcttcatggaacacttcgactttgctctccaacttatccaggccatattcccaatggcaagaattataaatgcatttcaaccaccgcattgggtttataacatttgaaggaaaggccaaatagggaactgtcaagcttttgctggagaaccaaaacagtaagacaggcacaagatattgtaccccagtgcttagcctgtcgtgttgtaacataactaaaagctatttttcactcgctttgctttaattaccaagggttttggtgttctaaattgctactgtccaagcatcccctgatatagctgtagtccaagaagttgaaggggtcctaagggaattaagggaatacagctgcagcccccaacaaatacctcaaatcctaaaatatgcaaactctacagaatgattgatggtatattctcagtattacttcaaacttcataaagtgcttgcaaacacaattatcacttcagctacatcctccctgcttgtgaacttgctgaaaaaatctgcttcttaataatagcagctaccatttgttaaacactttaatcaagcactgctgtgtgttgttttgtttgatcctcccacaataaccttattacataagcattactacaatcatatccactgccagatgaaaaaactgagatacagagaagttagaagtcacacaattagcaagtgtcagagctgagatttcaactgattgcctgacagcggcactctcactcaaacagtaagctatgctgctttcttgctaaatctttatcatgcccatagcttgggtttgcctacaaaaaaaagtttgagccatgaatacagcccttgacattttattgaccatgacagaggaaaaaaggtggcacatgatcacacttacgaaattgtttcaaggaaagaaaaagtagagaatcacaaggacaatctagttatgaaaatatttacctgaatagtctctgtaatcattgtagagcaggcaagagaaataataagttattgcccagggactccatcccctgagcattcaaaaagacaagaactccttcacaattgaatttatagccattaaatgttttcattgcaatgtttgctttcttattcaagtgactgactccagttggaaatatttggggacctcaagataaagccttgatgggaatgtggcatgccttacaaagtgttacaaaaagcaggtccaggatatgagactttatttcttcttaggcaatacactgaggtacctctgggtccagctcttaaaagctaatgcttccgttctcaagtaggcagtggagccactgttttctcagaataagaagatacttctttcagtttgtgtgacatttgtgaagaagaatttttcaagttttcctgaacacttttccatatttgttgcaataatagaagactattcaaattaacctcatccattcaggtatttaacatcaatatattcacattcagagataaaaggaacttttctatctggagagcttcttattaactgttcttatctggtcaaatttcactagtcagaccacaggaagttgtagatcctagcactgcccggatattggactttctcccacatctctgcctgggaactgccagctgagttattgctgtcggagaagtatgcagtgtgtctgggctttggggttatctgatcagcagaggcatcggtgagtaaagtttattttttcccctagccaaagaattataaactctgagtattaggcccggaataacctaaaaggtcatcttgtccaacttctagtcaatgtctgcatcacttgaacagcacatttaggctcctggaataataatagagtagaaataaacttgagtgcttactgtataccagagatgatgctttatacataaactcatttaatattcataatatcaatctgaatcagaaattattttgtagataagaaaactaaagctctgaaatgttagacgttttgaccaagtccacatggaagtggcagggccaagattcaaacccaggtctgtctgcagagcccacacttttaaacaccacattgttcttcataactcaaatatctgggaaaactctgtctaatattccatcgtgttgtttctaaaagttgactcatacttgtcagaatactcatatcagtgtcagattcagaaaatttagttaccatgcttcttccttcttatttaaccccttcctctcccaccaatagcaacaaatctacttttatttttaatattagccctgtattccatggtgagaaaaaaaactgttggttagcagaaacataaacctggtcatcaaatcatgaaattcaaagacaaaataaaagcctttcttgaaagaaaacaggaaattaagaactaaagataaacctgcaataaccattaataagtaagcagcagctgggcatggtgacgtgcatttataatatcagctacttgagaggctgaggtgggaagatctcttgagcccaggagctccaggctgcagtgagctctgattgtgccactgtactcctgcctgggcaacagagtgacaccctgtctctaaaaataaataactaactaaataaaataagctagccccaaaagttccactgagttccaatttaaatagactaaagatcccctggtcaaaatgcatctctattgttcactgggttccataacagagagtgacaagaattatttgtctggcttgtttaaagttatttgtcttcaggccgggggcggtggctcacgcctgtaatcccagcactttgggaggccgaggcgggcggatcacgaggtcagaagatcgagaccatcctggcgagcactgtgaaatcccgtctctactaaaaatacaaaaaaaattagccgggagtagtggcgggcacctgtagtcccagctactcgggaggctgaggcaggagaatggtatgaacccggggggcggagcttgcagtgagcggagatggcgccactgcactccagcctgggtgacagagcgagactccatcccaaaaaaaaaaaagttatttgtcttcagagctcatgtccccttctgcttgttagatggtggcctcttctagggcaggaagtatgtctttatctctgtttcctttcaagtatctatacatttctctttccaacatttattgtgcacccttactgttcttaatactgtactgagtactggatacacatgaaaaaacacagtctctgactcagtctggtggcaaaacagatctctaaaccaatagctgcaatttaataaagagtgttctaatatccaataaaagtacgctcagagtgttgtaagaacatagcagatagcacaatgtcatgtcatgcacattgcaggtgcttaatatccatttgtccaatttaatttactcaaagagaagaagagcttagctcaatagaagggaactatgacctacgtgatagatcaaggccacgacaagtatctaaaaccaactctctctcagttcaagttcctttatgtctcacacttaattccccaaattaagaccagcatacacagagtgttccagctattaaaatgcagaacccaattttctatccttaaatgtttttactccaggatttcactctgcaagtgtaatattgtattatcatatgtcccagaaataagttgtaagtgggttggaactgacaacagtgatagaagtgatggaacccaaactttcctgttaataccggttaaagtttcagagttagagagggtgtgggcaggggatgtttaccatgggtagatgaaaactgacaagatagaagatatatgcagttaagagcctctgaaaacagggaatagacagttgtgtaatgctggctggctggaaatagaaagtaaataactggtgttgccagcacaagtaaacagcaaacaggaataagtcatcagtgagcatttgatgaaaaccagttatggaagtagattaggggttattttgaatagttattaggaaaaatgtctgggtgaggtaccaatgggaaaagaaaagatctggaatcactgcaggaaaaaagaactggacacgcatgtgatctttttatctccgctctctgcctccctctgtacccgctctgtgctcatgtttctttcctttattgccctgatccttctctttgcgtcataatttccatcaaacaagtatttattagtgcctcctatgaacggaacattgtgccatataaggagataaatgatacagggttcctgccctcaaagaactaacagtctagagaggcagataaatatgtactttttatatggaattaactacaatttaatgatgaaagtggcatgtgctctaacagaggggaaaagaaaaacaaaatactgtgaaagaacattggtgaaagatattaattctgactcgggagaagggcatcttgaggagattaagcaaagacaaagaatggctagaattttaatagaataaaggtaggtagtcattcttgtcagagggatttgagaaaagtcataaaacgtggcatgtttgaggaatggtgggaatggaatatgtagggagaacaatgcatcctagcttgccagggatttcccaggttttagcactgaaagtgctgtatcctggaaaacttcttagtcctgtgcaaacagggatgattggtcaccctaaatatgcatgggacattgggcatatgcatcatagggagtaaaaaaaatgaagggaaaaccaaagatcagtgaagacaacccataggaaattaggttgaagacaggacatgaagagtaccaaatgtcaggctaagaagtcatgacttgtttttacaggcagttgacaatgaaacagaggttttggataggggagtagtataatgaaaacataagattactctggcaaaaatgtccagggcagatgaaaggggtaaaaaactagtttggagcctattttgaaaatccttgcaaaagacacacagaagactttgacaaggaaatctacaatgggaatggagcagaggagccatagcgaagagacagtgcagtggcaaaaatcactgaaccttactgactaatatgggaaattgtagaaaggagggatgatgacaatgttttccaacctggtttattgggaaaattgaggtgccattagcaggaatagggaagtagcaatgatagttttaaatggaatggtgacaagtttattttaatttagtttccaacaatctggggttgggaagccaaataaacacgtgattcatgagctaaagaagatgtctgacctctagttataagctttgggagacatgagtataagaattagactcagatataagtttaattatatatgagaggtcagatatgaccatctatggaaagagtaaagttacagaaattagtaagaaatacatggtggtcattagagcctgttacaggtactccagttctcacctccttccaggtacataacaacattgccatgtgattgcttttgccaactaaatgtcagtaaaagtgacttattcacatccaggcaaaagcttgaagaagccatacagaattcactgtgcttcttttatcctgcttcagcaatcattaaagcaggtgtcaagaagaatcccctattcagtctgggtccttgggtcacttcaatgagcggagacaaatgtcattactatgtagcatgagcaagaattaaacctttgttgtttcaagcccctcaaagtttaggggctgtttgttgctatagagtaagctagcttatcttgaatgccactgaaaacttagaaatacatacatttagaagttagaagaaagagggaactgacaagtgactctttcatggggatggcgcagaagagccatactgaagagagagtgcagtagcaaaagtcactgaaccttggtgattttacagtaaagtatacaatttacagtaaaagaataagcagaggtgagaagtacataaagcgaaaatgaatcttagaagacaaaagaagaaaaatattcaagaagtgaaggtagtaagtagtgttagatgaaatgaatcaaagactgaaaaagaacattggatttggtcattagtagtacattgggttactttctaataagttcagttgtgtgacagaaacaagcaagggattgagaagttaacagggagtgtgtaaatggagttaattaatgagggtaatcatttttagaaatttggtaaagagagaaaattccttaagcaatgtcctaccttccgttggataagcatggttttttctctctctttccatctctttgcttactctgcttcctccatattatcctggttctcttcttctagatctgcctcttctctgtcctgccttctctatgcccctgtgtctctttgcctctttttccctatgatggcatgataactcttacagctggacagagtgggcctagttcagcctgtggtccaatacaggagactcctctattttactgctgatcagactgaaattaaatgttgtatcactgaaggagttagctcactaattcatggaactgcctatcccgtaattgtcagataaatctagctatctagacagaaaacttgtctcctactcagctgaactctgcctccctttaactttttctcagtcctaattctacgctccctataccacaccagaaatgttactctcttttgtaccttgtacttgatattcatgctctcttttctctttgcccattccttatcctcacctttccattgtctcagagatgaccctcaactataaagaaaatattaattttcttattaatagcctcagtttcatcaagtggttgaataaatgggccttctaaaaatatacataatttagatatagatatatagatatacttttatgaagaacactaaatttgtaacattgcaaacaacttacgttaaagtgtattttcaactattctgtgtatgtgtgtgtgtgtgtgcagtgagtcatataaagaagtgctagccttcttgttttgaaaaaagaagaatttttaagtttgcaaggaaagagttagattgagtattttaaaatcatcatattcttttcttcacaaacaaaacaattaagtttttaacttttttttacttatatatgtccactgacttatatgtgggagttgggtcagttatgctcagtagtaaaaagcttcttatacctaatttagataacttctagaatgataaatccatatggctcaattaagaaaataaaggagcttggcggacatcactcagccatgcaccctcttaaactttcctttgtatttctgtccaacactgaatccttagcttgaataggctattgcaatgctcttatgagggcttattgtcaagaatacagagatggtgggaaatcagttccaatgcttaaaaacactgtttataaagcacttctctgactgaatgtttttcccagctttggagagtaaggaaaggtgtaaaaatgcaactactgaattcctaggctcccttacaccttaaagagaggcaacaagcttgacttcggtgaaatcttagttgtattccttcttccagaaacaacagtcttgtgtttgcatatctttataattttcacagcatttccccgaccattatcttgttggaatttcacaattctatgaagtaagaaaggcacgtagttttccttattctatagattacgaaactgctgctcccttgggccacatagcaagcaaatggttaatccaaaactaaaatgtccttactcattactcattcctatgattcacactggttctttgaataataattcagttacatggtagtatagttatgcttggcaaggattgcatgtgattccacaaaaagcaagacccttagatggcacagagctgcccttggcacatccctgactcctcttcctggtcacatccctttctaagttccttgagttttatgactagatctttggtttctgctgtatctcttaccttcttgtgccaaagaaactgttctctaaaaacagcagatgctcaagacctgaagtacaactggaagcaaaataattttgattttgttacctaggcaaagacaagggaaatgttctgtttagaatttgagttacttgcccttgtatctaacagcttataacatcattctgggccaagtaaatgccttggcaggtgtggaaatttctttgaagagctctacctcacctgaatctcttattatcgatatggaatcaggtatagtcacgcaaacaaatctcgattttaaaatgccccttttaatacaaagagtctgtaggagggtatggtcctaccttttcaagtatgactattatgagtaagaggaggagctaaaaacaaggtctctttgacaataaagttttccctaaccacaactatgagaagattcaaaggaatacagttagactagcataaaacatgtcttcctttcctgccctggtgaagttcccccttatcattcagccctgaactttctccagtcccatcttaggattacatcacatttgtcatacctttccttttatctttatagaaaggatgatgatttcctcagatgaagaaaatgatacaaatatgatggaatttattctggtaggactgtccagacagcctgcatctcagctactcttcttttaggcaatattgttcatctactctgtcaccctggttggtaatattctcatcattgttattatccagattgattcccatcttcaaacccccatgtacttctttctcatacaagtatccttcttagatatctgctccacacccacggttctggtgaactgctagaaggactttccaagtgtatcctatagtggctgcttattctaaatgactatctttctttacttaggggtgacggagtgtgttttttttttgttctgttttgttttgttttttgagtcggagtctcactctgtcacttaggctggagtgcaatggcacaatcttggctccctgcaacctccacctcctgggttcaaacagttcgcctgcctcagcctcccgagtagctgggattacaggtgcccgccaccatgaccagctaatttttgtatttttagtagagacggggtttcaccatattggtcaggctggtcttgaactcctgacctcatgatccgcctgccttagcctcccaaagtgttgggattacaggtgtgagccaccatgcccagccgagtgttttcttattgctgttatggcctatgacaggtttgttgccatctcaaaacccttgtgttacccattcattatcaatagcaatgtttgcatctggatggtggcaggagtttgggcccatcctggtcgcaccaatccaattctgtggccacaatgtagtcaacattttacatgtgagctccaagtaattttcaaactcacttgctctcctgtactagtcaaagagatccagtgattcatgattccaggttgtacattataggcattgtatcagcattaagtgtgctcctacagttaagctcgccagcaaacccatcccaggagctgagaggcatacaattagggcataaggtgaggtattatcggggtacacttacacaaagtatgttgaaactcacacagccaattgccataatgaccattgaattagcacataggtaaagctgagatgtgcaaacagatacctaatacatttccagcacctgaagatggtcttttgtccttgtgccagatccacccaaatgtctaggtattctaagtcttttccttttattgcttctatctgacatctttaatgagcccatgtcaagacatatcaaatatctatatgtcatggggatggctggttacaaatgaaaaaacatatggaaaaatatttcaacagaggggaaaagcagtatgaaaaaaagcaagttggaaacagaaactcaggccctacatactgaggtagaaccacctttttggatggtatcacgtttttatcaaggaggtacctggcagccagaaataaatagcccattttataagcctgaatgacttccaggatgtggagaactgtagaaaagagttttgcaaagacaactatataagctggtgctggtaaaatttttactagttcatgttgaaatgaaaagaaatgaaggtaaagtaatgaactgttcatagtttaattcaatcacaaagagtattctaaggtaattcaatgaaacactatttgcagtatcaaaaggttggaaataatggaaatgcctattaataagtgactgtttaaataaatttgatatatccgttcaacaaactactatacagctgtaaaaagatttaaaaagctcttcatgcactgacatgaaacgcttttcaagataacctttttggaaaaaatgtgaacggaatgctacacacatacatacactcctccacacagacagacttatttacttatttatacatagaatatctttggaagaatgcccaaggaacaaataacagtggctgcctgcagaaagggaaactgggtgttgaaggggcagggtaagagggagccttttaattgtcaattcttttttgtttttattgatacataatattcgtagatatttatggagtacatgtgatattttggacatgcatagaatgtgtaatggtcaagtcaaggtatttaggatatccatcaccttgaatatttatcattactatgtgttgggaatatttcaagtcctctcttctaactattctttatggttttgtacattttgaattttgattaggaattgttctttccttctaatttgttgcctaatttttgccttaaaatagtattttaaaagaaataatagggttaatacattgtagatattttgttatttcatttttaattctgtatatatttacatagcaaaatgaaaagttggtgtattagtctactctcatgttgctaataaagatatacccaagactgggtaatttataaaggaaagaggtttaattgattcaaaattccatatggctggggagacctcacaatcatggtgaaagacaaaggaggagcaaaggcatgtcttacatggtggcaggcaaagagaccatgtgcaggggaactccccttcataaaaccactagatctcatgagacttattcacaatcatgagaacagcatgggagaaacccacccccatgattcaattgcctcccactgggtccctcccacaacacatggaaattatgggagctacaattcaagatgaaatttgggtgggaacacagccaaactatgtcagctgacaaactcacttaaaaaaataggtacacatacgtaaaatccaaaatgttggaaccactgctttaaggtcccttctctggaattcaacaaccagtctgtctcattgctgttcccctctgaccttgtgtcccagtcctgaaccagtgtctctgccttagacacctgcttagtatcccactccctcaaggaatcagacctcactatgctattgtcactcaatgtccttcaccatcaccaccacccatggattagcatcctatccctgaaatgggaaaatgtgatgggggcccttctaccagctgctggacctccctgctggacacaacttgattcatttgctggagtggaatgctaagaagagattgcatccctgccaaattcatgttaaagcccaaatctccagtgggatggtatttggaggtggaggcttggaaggtaattaggtttagatgaggtcatgtgggtgagggctcccttatgggattaatgaccttatacaaagagaaagagacataagatttccctctgtatgtgtgcatccaccaaggaaggccaagtgaagacacaaccaggaataaggccttcaccagcatgcaatcatactggcacttatatcttgaacttccagcttccagcacagcaggaattaaatttctgtcttttaagacaatcattctaggatattttttataacaccctgagttaagatagtttactttctttttatgcttaaggaagtaggattttctttttttgtatgtcttttcccacccaggtttattgaggtataattgacaaataaaaatatatatattagggtgtacaaagtgatgttttgatatatgtgtatactgtgaaatggttaccacatcaagctaattaacatatccatcaccttatatggctactttttttgtggtgagagcacttgagatctactcccgtggcaaactttaagtatacaatacagtgttattaactatagttaccatgatgtacattagatcccccaaaattactcatttcacaactgaagatttataccctttgaccaacaacgcccctcttacccaccccttagctcctggtaaccaccattctactctccatttctatcacttcaactattttcaagatggcgcatataagtgagatcatgcagtatttgcctttctgtgtctggcttagttcacttagcataatatccttcaagctcatctatattgtcacaaatggcaagatttcctcctttttgaaggctgaataatactccattgtgtaaagatatatatatacatgtatgtatatatatacacacatatgtatagatatatatctgtgtgtgtatgtgtatacatatatatatatatatagtgtgtatatatacatatacacacaaacaccacattttctttttccattcgtctcttgatggacacttaggttgtttctatatattgattactgtgaatagggctgcaatatgcttgggaatgcagataattcttcagataatgattttatttcctttggatatatactaagtagtggaattgctggataatatagtagttctattttgaatttttaaaggaatctccatactattttccataatggctgtgccactttacagtctcactaactttgtacaagtgtttccttttctccatatccttgccaatacttgctatcttttggctttttggtaatagctatcctagcaggtgtcaggtgatatctcattgtgattttgaattgtatttctttgataattagtaatcttgagcaccttttcatatacctcttgtccatttgtatatcttctttggaaaactttctactcagatcttttgtccatttttaaattgggttgtttccttgctattgagttgtatgagttccttatatagtttgaatattaacccctttcagatatatgtcttactaatattttcttccattctgtagcatgcctcttcattttgttaatcaacaaaattttttcttttacaacttttgttttggatttgggagtacatgtgcagattcgttataaaggtatattgcatgatgctgaggtttggggtttgactgaacccatcacccagatagtgagcatagtacccaataggtacttttttcagcccttgcccgcattcttctctcccacctctaatagcccccagtgtctaatgttcccatctttatgtccatgtgtatccaatgtttagttcccacttacaagtgagaacatgcagtatctggttttttgtttctgtgtcaattcacttaagataatggcctccagctgcatctatattgctgcaaagagcatgatttcatgtttttttatggctgcatagtattccattgtgtttttctttatccagcctaccattgatgaatacctgggttgattctttgtctttgctattgtgaatagtgctgcgagaagcatacaggtacatatgtccttttgatagaacaatttattgtcctttgggtatgtattagtctgttttcacactgctataaggaactacctgagactgggtaatttataaagaaaagagttgtaattgactcacagttctgcatagctagggaagcctcaggaaacttacaatcatggtggaaggtaaaggagaagcaagcaccttcttcacaagatggcagaatagagatagtgtgcaggggaagctgccacttataaaccatcagatctcatgagaactccctcactatcataagaacacatggagactgcctccatgatccaatcacctcccactaagtcccttccttgacatgtggggatttcaattcgagatgagatttggatggggtcacaggaccaaaccttatcaaggtatatacccagtaccattactgggtactcgtgctgggattgcttggtcaaatgatagttcaccacttagttctttgataaatgatatttcaccacttagttctttgataaatcaccaaactgctgtccatagtggctgaactaatttatattcccactaacagtgtataagtgtccccttttctccaaagcctcgccagcatctgttattttttttgcttttaaatagtaaccattctaactggtgtgagttgctatctcactgtggttttgatgtgaatttctctgatgatcagtgatgatgagcattttttcatacatttgatagcgacttatatttcttcttttgagaagtacctattcacatcctttacacactttttaatggggttatttgttttttgttcattgatttaggtttcctatagattctggatattagacctttgtcagatacctaatttgtaaatattttcttttattctatatgttgtctgtttattcctttgatagtttttcttgctgtacacaaactctttagtttaattaggtcccacttatcaatttttgtttttgttccagttgcaattgcttttaaggacttagtcataaattatttcctaaggctgatgtccagaatgttatttcccagatttttttctaggattcttatagtttgaggtttacatttaagttatcaatccatctcaagttaatttttgcttgtggtactagataggggcccaggttcattcttctgcatatggataaccagttatcccagcaccatttattgaatagggaatcattgccccattgcttatttttgtcaggtttgtcaaagttcaggtggttgtggatgtatggctttatttctgggttctctattctgttccattggtctatgtgtcagtttttcccccagcaccattctgttttggttactatagccttgtcatacagtttgaagttgggaaatagctatttggggacttttggggttacataaattttagcacttttttttttttttttttttttttggagatggagtctcgctctgtcgcccaggctagagtgcagtggcatgatctcggctcactgcaaactccacttcctgggttcaagtgattcacctgtctaagcctcctgagtaactgggattataggcgcccgccactgcgcctggctaatttttgtatttttagtagagatggggtttcaccatgttggccaggctgatctcgaattcctgacttcatgatccacccacctcgacctcccaaagtgctgggattacaggcgtgagccaccatgcctggccagcatttttatatctctatgaaaaattctattggaatcttgataagaatattaatttttcaatctatgaacacagaatagctttccatttattttgggtctcctacaatttctttaatctatttttttttttagttttcatcttcacctccatggttacatttattcctaagtattttattgttcttgatgctattgtaagtgggatcatttttggatagtttgttgttagtgtatagaaacacagttgattgttgcatgttaacaaaattcaatatcctttcatgataaaaaaaataataaaactcttaacaaagtgagtataaaaggaatgtacctaaacataataagagccatctatggcaagcctgcagctaacatactgaatggtgaaaagctaaaagcttttcttctaagaacagaagcaaaacaaggatgcccattcttaccccatctattaaacatagaactggaagtcctagacagatcaacttggcaaaataaaaggaataaaagccatccaaaccagaaatgaagaagtaaaattggcaccgtagccagggtgacagagagagaccctgtctctaaaaatatttttaaataaataaataaaaataaaaataaagttgtacaagcatctctatcattttaaaaaagggagtgaaactgtctatgtttgcaaataacataatcttatatattgaaaactctaaagattccaccccaaaattaataaattcagtaaagttatggaatacaaaattaacattctttcttccagctttatttatttatttatttattttttgagacagagtctcgctctgttgcccagactggagtgcagtggagcgatcttggctcactgcaagctccacctcccgggttcacgccattctcctgcctcagcctcccgagtagctgggactacaggtgcccgccaccatgccaggctaattttttgtatttttagtagagacgaggtttcaccgtgttagccaagaaggtctcaatctcctgacctcgtgtctgcccgcctaggtctcccaaagtgctgggattacaggcgtgagccaccatgcccggcctcttccagctttattgaagtataattggtaaacaaaaactgcacataatgagtgtatacaactgactgagttaatatctatatatatgtatatagatatatatacacataaacatatacatatacatatattcatgttatcatcactacaatcaaggcaataaacatatctttacctccaaaagtttccttctgttccctttttgttgttacttgcttgtttttgttaagaacatttcacatgagatctcccctattcacaaaatatcaagtgcacaataccttattgttaattataggcactatattatacagcagatctctggaacttattctgtataactgaaactttacgcccatgaaaaaatagctctcaggctggacacggtggcttacaactgcaatctcagtgctttgggaggctgaggagagagaatcacttgaggtcagggttcaagaccagcctggccaacatggcaaaaccccgtctctattaaaatacaaaaattagccaggcatggtggcacatgactgtaatcccagctacttaggaggctgaggcatgagaatcacttgaacctgggaggtagacgttgcagtgagctgagatcgtgccactgcactccagcctgggcaagagagcaagaccttgtctcaaaaaaacaaaaacaaacaaacaaaaaaacagaaacttccctctgttccctctcccccttgcctggtaaccaccattctattgtctacttttacctgtttgactattttagatgccttatataagagaaatcttgcagtatttgtccttctgtgactgactcgcttcacttagcatcatgtcttccaggttcatatatgttgtttgaaatggtagaatttccttcatttttaaggctaaatagtgttccactgtgtgtgtatatatatatatatatatatatatatatatatatatatatacacacacacacacacacatacacatatatatacacacacaatatgtatacacacatatataactttttttgtctgtagtatatataaagaaaatgcaataaaatattatactacatataaagaaaatatgatactttattacattttcttttttaaaataattttactttaagttctgggatatatgtgctgaacgtgcaggtttgtaacataggtatacatggttatacatgccacggtagtttgctgcacctatgaacccgtcatctaggttttaggccccacatgcattaggtatttgtcctaatcctctccctcccctttccccctattccctgacaggccctggggtgtgatgttcccctccctgtgtccatgtgttctcattgttcgccaatattctacattttctttatctatttatctgttgatggacatttgggctgtttccatatctcggctgttgtgaataatactgcaatagatatgagaatgtagatatctctttgcaatcctgttatcagttcttttaaatatatacccagaagtggaattcctggatcataaatacagtagttctatttttaatttcttgaggaacttctatactgctttccataatagctgcaccattttacattcctaccaacagtgtgcaagggttcacttttattcatatcctcaccaacacttactatcttttgttttcctttctaatagccattctaacagatgtgagatgatattgtgatgttgatttgctttttcctgatgattagcaatgttaagcatcttttcatatactgtcagtcaggtactggcacaaaaataggcatatagaccaatgaaacagaatggagagcctggaaataaacacacacatataaggacaactaatctttgaaaagagtactaagtatatgcaatagggaaaatttgtgtcttttcaaaaaatggtgttgggaaaagtggctatcccattcaaaaaataaaattggtctcttatcttataccatacacaaaaattagctcaaaatggattaaggacttaagtgtaagatattttaactctaaaatagttagaagaaaacatagggaaaacgcttcttgacgttggtcttgtctatagtttcttagatatgacaccaaaagcagagacaacaaaggcaaaaatagacaagtggaactacatcaaactaaaaagcttctttactgggaagaaacgaaaggcaacagaatgaacagaatgaaaggcaacctacggtatggaagaagtatttacaaaccatatatctgataagggtttaatttccaaaatatataaggaacttctacaacgcaatagctaaaaaaacaaaataactggattttttaaatgtctgagagatttgaacagacgtttctccaaagagagtttactttctaaagtttactcattcctgcatttttctttacttttctgtaagtgcctgtgaagctttccttgccaactcatacttatttggtccctctgatgtccagggtttgcattagaaaacctcccttaaaatatcatgttctgcttgccagattggaagtcagcccaaggatcttcaagacgattcttcttttcagctcttctttacaccaaatggcccatattgagattatgtcctgtggcagagattgcttgttatctaccccattatccattttctcgatcttctttggtaacaaatcactgaattttattcaggtggtaacatatctagctaaaagaatacaattttcagcctctcttgaggctaggtgtgttcagtgactaaattagtattaaaatataagtcaaaatattatgagaaatttctagaatgtcttaaatagaagcaaatcagtccccccaccaccaccccttattttcccctttctctatcctgatgcctagaatgcaaatgcaaaaaggacatgtatctatctgaaatgttcatagaaaacatatctggaactctaccatccttcttgttctatgagaataagggcagaatagttaactggaaataatgtgagtctgtgaatatcagagaattatcatagctgttctacacttctcatcttcagttaagtgatgtacaaaaatcatccatcttgtttaagccacaattatactaggttttctgtcccttacagctgaacttgattctaactgatatatcttacctgttatgtttccatgtcccattgaaggtgactaagccatgccccacagtgtttcaacacccgacatatctgagtaataacacctccctacatatgtaagggacatcagtatgaatagaattttaaaccctgctcctactgttgattcttttgctgcctacataccaatttattgttattattttgtatacttggtgatgattgctttacagttgatttaattctcactccaaaccatgaggggagaggaagtcccatggcatgagtgagacatgctgctctaagacaatcaaaagagaagacgttggacatgccgagttcaaactcatgaaactgtcaaatcttatttagagtaatgacaaccaaagttctatctacagctcagacatctcttctgagttccaattacatgtgtttgtgtaaaaagtacatgtatctatctgaaatgttcatagaaaacatagattgagatattctgaaacagaaagcttcatcttcatcctaaaatctcctcttcctcctgtttattgcatcaaatggagccaccatccaccttgaagacatcccctaatcctcttgttcccttactgcaacttccaatcatcctccaggctttgcctatcctatttctgtgataaatctcatccatccctagactctcatcccactgcctctcccttaactctggccctcatcatttcttgctctgaccactgcagtgacttgagatctggtatccttagcaacacagtctaacacaggcttcacattacggtgccacccacttttatgagacatgtcagagcatgtcactcccttgtttaaaagttcttcatgatgtccagtcatgaaggcaaaaagttcaactcttcaatgtgacatttaagaccttccaagatctggacccagcctatatggcttttctgactcttgctgattcagcaatacaaacttattaacattcccattaacatctccttcatttccaattctgagcacaggattgatgtggtgtctgtaaaatgcatgtggttctcaactagttaatccaacccaggaaacccagcaagaatgtttctaatatgagcctccttcgaccatcttttatctctgggcctaaagagtaagtccctcctttatcaatgtccccctgcacaagtttatatgtgcctcctttgtacatcccttatactttgtacatggctgtacaatgtaatatttcatgcagctaaacatcttggaaagcaagtgagagcggcatccatctggaacagcactagggtatatccatgctgctgtgtgaatttctccacatgtttgcatagatgtagcgccttcagaagtcaacagacctgctaccatcaaaaagaattcaacctttatgctcatgctcttttcattctactaacttcagggatgttctacatccccaaaaccccagcagcccctttgcctcctcttcatgcctggtatcacccaagctttgtgcctagactttctagcaggacccaggctgttctttctggacgtccctctaaaccagtgactttgtctctgaagatataaaatgagtttgagcagccaggcccctcaacataactgaccattcccaactactgaggacaccctgtccacctttgcttggcctgaatactctcatgtagctagaacctactcattgtagctaaattcaagatatcagaggaaatattatctggaatttcttgtcttcgtttttttttttcttttagaaaatataatatctctgtctggtagccctgcttccctcaaagcttacagtgaactgaaataaatgcagggaagtggtcctatattctgtacacttaagaaatgggaaattcaatatttgtttacaataacggcaaagttaaaatagctcatgctacattgccaaatgaagaatagcagagacataaacactgtccttaaaaagatttttttagaagaaaagtatgaatcgaatcatttactgaagtactgtttgaacagatggtgtgattaacagctaacatgtaagccatcttgggagtttatggaaaagtaaacacgtgcagctaaaaagaaatcactttattccccaaaaggttctttcattcattttactaagtaaattggaaagcctgggttttgaaggctgcatttccttgggggatgttaggaaggagcagaggagagtctcttcagagcaagaccatgtcgatgcagggtcgagctccaaactcgcctcctgagggatgaaatgatctgaggacctggcccctcccgtcagctggcccttgacaacaactgaagatgctctgttcagcttgctcatctccagtggcttcacgtgcctgagaggaggggaaaggagttaaggtttgggaatcagttcctggccctctgctgggcactttgcatggactgtttcctctaacgctaacatccctgggggtcacgtgttataaggccaacttacccaatagggaaaatggggtttaaaaaggaggaagtggcctgccaaggctgtatagatacttccttcatggagctgccattgaaaccctggcctgttgagtgggttgtcaaggagagtgtggaacaggatatcaggggacatgggtatgaaagtctgctctgctagcgtgtgctttggggaaaactgctgttcccttatgcaccacagcttctacatctgtaacatgtgggtgccataccggatggccttaaaggtcctcatttggatacagaaatggcatcaggatattaagttggcttccagccccattcctgatcatcctcaactgacattaggaatacatccttggacacttctgtagctgaagccatggtgccacctacttaggcaaacctctgaaggactggctgatccttggcagagctttcttgccactgcctacaccacagcacaccccaattggtaatggctcatccccaaattgccctggtgttcatttattcacctaatatttattgagtgtgcactaacactccaggcaaggaagtgtggaaacattgtgagcaagagggatttggtgtctctccttccaaaattagacccagtaaggagacacagaagtgaacagataattgaaatatagagggataaatgtgagtataagaaaagggaacttgacctctacctgtggaatcaaggtatgctaccttgttgatggtagtgatgatgacaccaaactaattttttagtggattttttcttttccccttctttttcttagatctacctcatttgtcatataccaaactaaacaatttttatcaaacatctagatatttagaatgatccagttgaccgttatagatttgcttgcctttcattctgatattggtactacttagatgcccatgttggtttcccaggccatttagagtcaaaagttgccaggaaggcaatgaaatcacttatgtttccaaagatagagtggcttaattaaagaggaaagcaaattttcatgttaataatctagaaataaagcccttctcttggacacgtccctgtaaatgcttctgagctctttcatgtgaagggccttctaattgcttctctgggacttagtcctggaagctttgaaagggtttcccattgcaatattagaaccactgatactgtgtcccctagcaggtgtgattccacttccttttgtgtgcatgtgtgtgtgttattattattatttctttttttttacaaaatcaactttgagaatattctccccatttagtaaagggaatgcaccttttgagttacatttgaatttcactccaggtctctactaaatggaatgaaaaagcctactgtgcattctgtgctgatatgtgacagtcttcagagaaaggactcctttcttagatggcatgacccattaaatattgctccaggtcaacagaagaaggaaattgctgtcccgcctcaggtacccatctgctataacccttggccctttgcacctcactttatagccacttgaatctaagtgtcatcctcaccagtcctatcctactgtgtgttcctgcagataacaatagtgtcttgggcttcctgagatgccacttgctaaaggccaatgccttatacttagtaggtgctcattccatatttggccaatgtcaaaactttcaacattgctttattgagctctcgatactgttttattggcatgtaaagcctgtcataattcatcttcgaaggcagtcatcttcattcctttccacatggcaccaatgtcatttcattaatttaccaggtggtaaaaacatactcaaaaccattcattctgaggatcttttagatttttaaatctttatatttgttcacctccaataatatgtcatgaaagctaatttctggccttacagaccgtatgctactcctaggggagagaaaaatggcaaaataagtccttcaattcaccatgctggacttttccttggacaataatctaataaaagaacaacaaatgtcaataaaggattgtaatattttttctaagtctataattatttacttgcacagttgttctatttcgttttcactgaaagctttatcttaaattgtttatttgttaaaaaataaaatattgttcatcatgagttttgatagtctctgtatattgaccgtgggaaaccaaacatacttgaaatcatagagcttagaagagtcattaaagattttctgttgccatggaaaaacgcttgagtgggaaagcaggtcacagcattctctataaagtgacataatgactgcagaaataagcataagaatgggaaaagaacccaaatattgtttatggtcatggctaacgagtggcattctgtttggcttcgcttccattactaacagtttcccgtggcttccacgttttacttctgattgaaaaaaaaaaccatacatttaaaatagtaattgtctagtaagattcatttgcttcatagataagaaaacaaaagtccggagtgtgtgggaaaacgaggagcggaaatcttgcctcaggactctaagtctaacttgtactttgaattctgatttgggagagacattgatttataatttcatttgtcaattcatccaaaagtttgggtacaataagaatcctatgcattttaaaacctggcacacattctaaagttaagtgggaaactatggttgtacatgaacaagggatgtgttgactaagtttcttctttctttgagatggagtagccatttggactcatcgtcttgtggcaatgccccttgccctactccctagtgcctcctctcagtcatctcctcttcccaagtgcacattgccaatagtagcttcagtcatccagaaatgctcataacctctggtgcaaaaggaaattagactgctctggcaaatggctgtcactgtgtctgagtatgagttgttttcactaaaggaaacctgaactttttggtgctaattcctgctaattgctgacacctcataattaaattggcagaaatttcactccagggtcatggcatataaaaactggcaggcttctttaaagatgactttctcaaaggactctgagactggggactgtgggatcaacggaatgtttccaggacttcattctatgaagaattcaatgggcacagagggccacaagggaatgctgtttaaggtagggcataagacttgtggatacctaaggaactagggttcatagcggccagtagggcatggtggtctccaattattataatgcgaaatgcaaatacaaagtggtattcaggctcgggcatatgatttcaagaataatcaccatcccttctagatcagcatttgacaaactacaacatgaaggccaaatccagccccccactgcctgtttttacagataaagttttgttagagtacagccatacccattcattttcatgatctttatggctgtttttgtactacaagagcagagttcagtagttgtgacaaaaatcaatggtctgcaagagcaaaaatattcctgaatacggaaaaacttagcttaccctgtcctagatcataaaagagaaaagttagaagaaataatcctaaaaggaaacaagtataaaagaagaattaaagagactcccaatctatagtgtggaagcttagcaatgaaacagcttgaaatagagatgaacggatgggagaaaactgtattcctggaataaaataggcatgtgtgtggacagttctttaagggcggttatgaatcatctaaagctggtgttgacaaactacagcctcctggtcaaaactggcccaccatgtgtttttataaatgacattttatgggaatacaatcacacccatttgtttatgtatcttctatggctgtagcgttactacaaaaacctttaataacagaatgagacatttaactcttatggcctcaagtgccctcctcttttggtcttccccaacttgcaagacctctgaatcagctttgcaggctccttttctttctctaagatttgcttattgttctccacccattctggccacatttccagtcttattacccattatctgcaagagcaaatgggagaaactttacctggaggcagtattttggcccatgattacatgtcatatcccaaatcatgggtaaaacacaaacttggaattttaggacttggtatctgcttaaataaattcctcctaacatattgattaatggatcaatgttatgttggaagaatgtctccagtgacatacccagggccctgttctgtttaacatttttatcaaatgacttagataaaaagccagaaggcaaatttatcaaatttttgttaacacaaagaaagcaagaagcaataagtaaagtttgggataccagaattaacattcaaaaagacctcagtggactggagctctgagtcaaactgaacaagatgaagcattgcttggcaaatggtaaagctcagccttgaggttaaaagaaaatcaattgtgcagttactggaagtgaactaaatggtttgagagtagtttgtgtgcaaaattcaatgtcagtggccttacttccctgctaagtaaaatgctagtaaaaatagctgattatcctaaatggcttagtacaggagtaccgccacagtctgtctcaggagcagaactgggtttgtggttgagatatcttggaactatatcatctaaaatgaggtggaaagactatagcattcctagcatagagaaacatactctgactctgaggttaattttattcacgagtttcagtggtaatcccaaatcacatgcagagattgcaaggtttccccttacacatgacttattatgctaacactaggaaagtcctggacaaactaagacatttggtcacactacattatgcttcagccacacttaactcctatctattcagcaaacagtttcaacttgttcttgccttggggtccgagcacttgctgttccctctgcctgggaatatcttcccctagattttcacatggccgttgggacattttggtcccaactgaaatgccacctcccttgaaacctcacatttataataacgattttgtttcaccactatctttcaaattgctctgttttattttcttcataacagttcttactatctgaacttattttatttgttacttgttattatctttctcaccacattagaatataggttaaaaagaaaagttttacctcttttgctcattgctctaccctcagcaactaaaccagaactgaacacgtaataagaactcaataaatatttgttgaatggataaatgaaagtgaatgattctgcatggtatatattctgcatatatacaccaaagtgctctgaaaaaaaaaaaccataggataagtcaaatccagagagctggcaaactttcagatgaggtcgcacaggtcagtatgctacggggatgagtctagtgtacttttattacaagctgggaaagctgatgtcaattgggacttacgagattgctatgtaagtactgtctacacccaggagagcaaagtctgggccgtttgcatgctctgtgctgtggtcttgaagtgaaaaatgtctattttcatcttaaatttcttgaggctctctagctctggtcaaattatcatcagagttttaagaaatttcaaattagaatattgagagaaaaatatctatggcctcacagccaattttccttttagaaatattggccatacagtttctttctattatgaactcccagaagatgtggttattttctcccaacattccagtccattccatcataattaggtccatagcatcatttcccctcaatgcttctttaaccttctgagaaatgaaattgtcagcaaggcaaatcccaaatttatcagatgctctgcttttaacagaatgagacttccatcagatgcctggacagctaaatccttccattcctgctgtagcttccctctatgccagttctgtaatcttcattatggaagcatcaaccatgtcctctgtgaaatatttccttgattgcactgcaatttctccctatttgtatgctcctgcaaatgttcaccatcttattctcctttacattttgtgtgaattttcacggaggtttaatatgtttttaacatgcaggatgagatggtccctaggacagaaccagaaagaaagggcaaatcttagtaccaaccctctatggacagataaaaggagtgactcacaaaagtccaatgtgaactgactatctggctgaaagttctcttctgctgtctttcaacagaccattgctctatcagtcaacattttttgtactaaggaactgaagatttaaaatttcagaaaaaaatgttattcagagtccaatggtcaaaaacagtatgactgaatgtagcacaaaactacttgaatggaagaatccatttagtcaaagtgacatcaagaggatttatttcagcaagcatcttttaagagtttcttctgtgcaaggtagaataccagagaaaacagatgacctagatttgtttgcaaaaatcaggggcttacagcccccaaagtgtacacccagctttaagtttagttatatagggtctaaagtccctaaagttaacaaacaactaaataaaaattaaatgatgcccagtctctgttggactcacaatcatacttgggagagaacttgactgatcaacatagcatatcattcagaggacccagcagacacaaaaggtgtcacacagtcctactgtgatatataccttggtcttcaaaattcctcaatattaaatcttcatagtactacttgaacatttaacttgcaagaagaaaaaaaaatgaaagaatgaagaattgcccagacagaaggaagtctcactttcttcaccacaaccatgtttactgaccagaatcattgctatcaggaacattcactgaaattctcattaaccaatttggaaggaaaatgaactttattttaatgagctaaacatagcagatgtctcctccttctttgttttctctctctgtgtgtttatattgggagagttaattgcaaagcagggacatcctataagtccccaaagtggaaacttttcttcaagactgaggttatcaattcttaaaccaccacatgattatctacatttctaaacattgtcttactcttgcatttgaatcctggcttcttttaatgctgctgaagtatttttggtcttgtacttagactatactttggcaaacaccaacatttttaaaagatttcagtgtattcagaaaggatatctcctcaatttatttttctgtagctgggaacaaagtaacagaatttagaacactagaagaagaaatatcattttaatatttgtacaggcaaagaaaaactgcatgtcacgaactggcatctatattaatattatatatgcgagaaaatgaattttttattgtttcttggacaccaacctatcatggtcgccttattacatgccacctctgtgtaaataaaagaaaaggatatttaaacaagtagaaataattgtgcatgattcaccagcacagttaacttaagattttggagccttataaccacaactgataggaagatttattaccacagctgcttgtattaaacttcttttccttgcagttgaaggaatcaaatttcttcttggagattagtcatttgtgggggtgtcgccaactgcaaaatgcttctgttatgaatgaggtgcacttctctgttgctgtcctccagccctaagtcagtgagtaattttcatctctttatgtgtctttcccgcctactatcaggaacagattttaatgacttacacagtcaaactttctttagttgttgctcaaacctaaaacttaagattgtattgtttctggtaatgtgataacctcacaaggaaaggtaggatggaatgacattttggcacatgtttacaaaatgaagtccaaactgtagggaaggtctacatggggcatgaaagcaggagttaaggtatcttgggtggctataaatgtgccgggcacatttacttatttatttatttgtagaaattatcttatctaattcttggaacaatcctgcaagaggctgggtggtattcccatttcacatatgagaaaactgactttctcaagactgtgcaggttttagtggctaaaccaaaagttaagcttaggtccagctggcatccttgctttctttctgtatgtcaacagtttgccttttagttataaagttataaagaattacacaattatatacggcactaatataactatacaatatggtgagattgacgctgtgtctaaatacgaaaattctaaagccaacagacacttcaattggtcatatctttcactccctactaaaaccatgtaaaactgaaaaggctctgtcttttcttattgaaaaatcctggaaacatgcattcaaaatttgccttgtcccttttcacaattgctagtaactgttttccgcatgaaatccttttatctattaagatatccccatcaccctttaagctcttgttcgaaactatatggagatgataggatctgcacatagtaagcttctgtcagccgaagatagatgtcagaacaattgagcaaagagtaagatttcagcaaatccaccaattgtttggtttattgcatgtcaatttggctactggtatttttccattgaattgactagatggtttagctacatatacactttctaattcaccatatataggtggttctaatatgacatataaggggaaaagagggttgaaaagtaaagaagtatttcaagcattcaaaagtgtatccttgagtttaaatttaaaaattattattaaagaggtgaatcaacttaaataaagctggaaaacatttttattgggcagatgtagcttatttgcccttttttttggtcaagggtaaaatcaatcatgtagctaaacccctttatgagagtaataattctatttgactcaatgtcaatgtaagtacctctatttgggttttaacagtccattcaactaaatcagtctgtcctaggtcatataagtttctataagacagaaaagcaaagagaacatatatttccaccactggatacttgaacagttgaacctaacccagtaaaataaatggcatacagcaattaattagagctccagaacatgaactataacaggctactgagatgctcttcctcttctttcttcatgtagatgacattgttttgtctcttttcccaacacttgagacaagtaaatgggtggtctaaaaagagacaatgcctctgagatgactgaactcatccttgttggatttgcccaacaccctgaaatccagactgccttcttcttggaactactgtttttctactagtcacagcgtttgagaacatccttatcgttgctgtagtgagatgagattctcgacttcatactcctatgggatttttttttcctcagtaccttatcctcccttgaaatgtgttactccatcagctgggagctataagtcttggctcaatgcatcaaggacttccccaccatctcctataacagctgttctgttcagatgatcacacacctctttctggggatgacagtgtctcctccttgctggcatggcttacaacaggtttgttgaaatctcttatctcctccattacactattattatgagcaatcgggtctgtatacagttggccttgggaatctggacccatgccttcttagtagcagtcacactaatcattgcaattcctgctagttattatggacacaatgtcatcaaccattttaccttgagatccaggccctgctgaagctcgtctgctcagacacccttgtcagcctgattcagggtctggttatcagtgtgttcacactgcccctgcccttcacattcatcctcatctcctaattttgcatttttgttgtgctgtggaggctaggcgtgaagctttctccacctgtggatctcatctgactggagtcaccatattttatggggcagccatctgcatgtacttgaaacctcagtcaaagggaacccaggaagaggataaagttgtctcaaaactttatggagcagttactcccatgttaaatcccccaatttacattcagagaaataaggatataaaaggtgcacttagaaagttagccaaaggaaatgaaaaatcctaacagttctctttaaacgtctccaaagtgcaggaaaaacagtgaaaacttggcctattatttcaatttatatttctttaaagcaaacaacaaaattttagtgagcattctttccatggtccccactaggcattcattaacaatttaccataaatattatcacaaaatttaccataaatattaacactttgtcaagccccacattaagacctaaagccatgaatgtgcccaaagtagttcacagagagaataatggtagtaggtatgtggaggcaggcgcaacagccatagtagcctatcagggagagccctttctcttgggtataagccataagatttttgtaaccaaacatctttgtacttgccacacaaagtgggaaaaattcatatacaagacagtggttatacaaccacaatacagcatttgcctctcataacacattttataggtgtgtacaccaatttgaacctaatggacaaatggcccctcaattctcccatttaggtgataacattccatggcaagaagtgtcttttgtatgtaaaagcacttatcttttaataagtgcttttaaattatatttataatttcttattttaaagtaatcttctctcaaccaacattgtttctacaaatattaaatttccatcgtatcaatttcttataaaaatgtctatactgaagttgttattcttttgccttctcctgtttctctgtctcctcttccatgatatgctttagcgaccctctggccatttcaaccccccatttctcatacacatttatgagctttagtatttctgctcttcccaagagtcttcctgaccaagattgtgattatttttctcctttttctccatttaataagatgctatatgcactttctgttataggcaggcaacatttattatatactttgtgtcataataacttgttattctttttctcatcttaactttgaccaactgactctaaaattctgccatagcacattcagaaggtggatatatatgtcttcttacttctaaaaccttctttcctcccatgacttttcttgggtagatggctttctggtcacaatattttctatccttggcttttttatttactttctttctgaggattgatcctttctgggttcttaaaaataccttacaaaattgtctcttcccataagttttctgccattatcatgggcaaatggagtgtgatgcttactccttgattgctgtgatttgctgccagagatcaagaggcaaattcattgggaagaacaattgtccattgattctgcctgacgctccttcattagggattttcttctgaatcagtttttctaggttttaagagggccaggaaaaagtccctgtcagttccacactgcactttgtttgtggtaccatgtatatataatcagaatatacatgcttggatggtgggcaaaggaatcagaaaacttgagtttgaattcgagctccacatttactagctgttccattacagcttaggcaagttacttaattgctctgtgcatcactttccccatccacaaaataaaaatagtaatagtattcctcttatagtgttgctggaaggattaaatttatggttcatgtaaggcccttataacagcccttggcacagggtagtcattcaataaatgttagatacaattgctattttctatatttcatccaaatgctcctgttcttttttttctaaagtctatttcctttatgaatctttccctccagacttcccaatgaggagctttgctagcccattctctaattttagaaacactgtaatatcatatttccctttggctttcatttttatggctttgctcttaatctgggtgactcctattccagttcctctgacctatgcttgatatattttaagtagagacagccccaaacttaggaatgagttatgtccaaaagctaactcataagtcatcagcttggaactcagagcacgttttctctactgagatagggtggctacattccaagggcagctcaccaacacctatttaggtcatcactttatcattaataatactaaaagtcctaggaccatactttttaaagtatgtttattggaagataggtgttgagtcgcaatgtagcattctaaaaacactgacactgttagatgggatttctgatccccaaaaaatattccatgagggtctctgccaccacactcatgtcctagcgggtatatgaggaattctcacagcaagttataagagtgggacttagagagcttctctagagactatgaaaataataactcacttctgtgtataagtcattcacaagtcagaggacttctgatcctctcttcatttctttttatgctatttattacttgtttgggatgacttgataacactgtacctcgggccaatcattccacaaacatttactacgtgtctactatgtgttagggatgcaaatccaaataagacattttttacctttgagatgatcacattggagctgggaagcaaatatgcaccagtgaagaactacagatactgtgatccacattatttatgaggtacaggcaccagctataactgggccagtcaagaaatatttaatattttagcagtcttgagagagagtttgccagttggataagggaggacaattttagtggacataatgtgaacaagtacagaggtacgaaacccagcttggtgtactttcagatactgccaacaattcaacattactgcagcagaaggtgtgggaagtgtttctggcaatatgtacgacctgagaaaaaatcagtaagccaaattagggggagacttgttattctctattaaagagcttgcactttcttcatcctagagatcaacaaattacagcctgaagggccaaatccagcccttggcttgtacagcccatgagctaagaatggtttgcaaatttctaatggatgtaaaaaaggcaaagaaaaatgtttttacaaagactgtatgtgtcatacaaatccagaaatctttactatctggccctttacagaaaaaaaaattgcagactcgtgcagtaagtaagtggtgggtaatcactgaaggttttgagcaagtcagtaaaatgttcagaattgtgctttagaaagttcactttcacaacaaatgtgaacaattgattgaagagatgtaagactggacatagggtaatatgattcgagcaataatctgagagctgatgtggacctgaactgtgctatagcaatagagatttggaaaagacctgtatcatagagtaccccttccttttttatttttacatgcaatttcatgcacattccagatacgttttctcaaaagcagcacagatataataaggagcttcagggataaggcaatctcaccttcaacatcactcatttctttcctaaaactaaatgagcacagagagatatggagggggatagggtctaaaggcacatagctgtgttttattcacatagtgcagccccttttctattccagaatagctctgcatgagttataaaattgcatttggttaaaacagagtgtttttgtcgaaagataataaatatcctctggcttcttacataatctctgaagttcactgatcacctgtcactcctttagacatcgtttagatgcgtttcatgcattatgaatcatgccactatgagtctttaataggaagatttctaaaagcattgtttagaaatgtcagtgacgttcagtttctaagtttttcatttctcaaacatcactccctctccttgttttatcacattggtcatttccttcttaacccatataccagagaaatccacagataaatgtttgctcagcctaccccaaaaagtcttggaataataatatctaaatgttgttcaagatatttgcataaatgttatctcatttgagcttcataaaaacgtgaagtgtctttacagatgcgtaatttaagaatctggaagctaaaaacatttgtccagagtcacatggctgtttaggtagtagaagcaggactaaaagtcacctctgaccacaaagctggtagatttatcactgtgctgcatctacaagggttgcagatccagattttctcatcaacaccttgttcatgatgttcactcacattttcagctgtgaagtctgttgctgagtcattccttgattttctgcatggttttgcgtaccccagtattagcctacatcctttcctgtattacagctccataaagaattctcataaatgacttgaagtcaccttaacctaactgtctaaaatctctcaaacacatgacaactttcttctcttcctgaacatgagaaaatgtcagtagccgtcctctttgctgcttcccactgttaccttgactctttcagtctactgcagatatttgtcatttgccctttgattttccctattttgattttatttatctatttatttttttactgtgctctccatcagtttgttctgaaattgaaaaatatctatttttctcttcaaagtatttggcttcatttctttccttgagagctttcctcaaattattttctcatctgtaccaatcctctctgacagcttggaatgaaagttgggcttctctccttgaccattcctcatcattttctatgccttctcttagttacatgaatttgctcatcctccatttacttctgccaaatttccaagcttttaagaaattaatttcagctagtactattgcatgatcagaaaaagcgctatctttcatttcatgtgtcggacctctactctctcttgcatataaatcctgtcagccctactggatcacttctttttttatgtaagcatattgcaaactgttagtatgcatttccaaataatcttctttcaagtctacatttttgcacacaattttctaaatattcagcttcactggtcaatttccaattctctctggctctattcccttttctgagatgcaattgaaatgtctctactccaacataaaatagaatggtttactctattttatgaagaatgaaaaaaccacatccttaatttacaaatctgagctgttctcttccctaattgtcatccttgatcaagtcttccagttgagatctcctatctatcatcagacctttgcatgataatgtttaacccaaaatcttaccccattgttgtactctcttcctccttttcaataacaagaaacttaaacttagccgtttcatttgaataattggcaagtagtataagcaagcactctatgttgtaaacataaaggaaatagataaattatttgtaggtaggaagaaacgtggaatacttctttaaaatagaagaacttgagcaaggttaatggaatatttcttttaagagagaagaacttgagcacaggtaggattataataatcaaaatgtagtgtgggatatgactctattccaagtggcaggaaaaaatgtgcacaagtttaggggcatgccatggagttcattttcagaatggctagctcctgttggctgaaagatagcctgcaagtgatatacatcaggaaagataaggtgggggcatgttgtagagcatattgctaaccaaagtagtttagactttattctttagtaaagagtaagccattggaaattttaaaaacaaaaataacatagtagactccaaaatctttactgaaggagtaggtggatgagtcaaagataaatccaaaatgtttcatttgggtgactaggaagagagcaacactctaaacaaagaaggaaaggagggggcttgctggctttggtaaaaagaaaatgggttcagctttggatattactgaacataaggtgttaaaaagccattcaagttgagatagtaatcaaatacatggatatgcaggtctgagaatttagatacacagataaattttggaagtcaaccacacagaggggataagaaatgttgtaggtgtatgtaaaatcaccatgcctgaagtcagaggcaagatcagaaggagtgtccatggagaatacccacgcttacagggtaggaagggaaaggggcagtttaaagagaagaagtggttgtatggaagttagtggaagaacccaaagactgagccaaaggaagagagaatttaaagaaggaggagggtgattaccaatgtcaaatatttccaacatatggaggaggaaaagttctgaaaagcattcaatttgacaattagaaagtcattagaaactgtcaaacaagatgtgtgagtaaaatggaaggttcaaaagctagaaagtaggcgtgagaaagcataggcaacaatgtaaactactttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatctgcccgcctcggcctcccaaagtgctgggattacaggcgtgagccaccgcgcccggcctgtaaactactttttagtaaagtttggtgataaaagaaggtgagaaatgagatagcttatgaatttatcaggattaagaaatgcatgcttttagaattgaagaatcatctgtatgattgcaggcataaggaaaggagcttggtacaaagtaggaaatatatacatttatgtatatatgtatatattttttcattagaaagggaggcagggaggcagggaagggaagggaagggaaggggagggaaatatagggtaaaatatttgtagcatagaaaacaaggacaactactgaagcaagaccctgaaaaagcaacaggtggaattagctaaccatgcacatgctatgggtagctctggcaagaagggaggtgggggcttctttctcagaagcagaaggaaaggataagtccagatacagaaaagagttaaagttgaaaggagagaaaggaccaaacagattttattcctctctgatcaatctaaatttctattacgcacgtttctattcctccaacttctgtgactgggactccaccttcaggaagcctgtagcatttgtttccttgcgtgtgtctctttcattcctgttctgcagatgttttctgtagcaagcctacatcaccatttctttcagtagccattagtttaccccagctgtttcttgctgccccctcagttttactatattcttttattcctttctctacccctacctaacatctatttttattcttctccatcacgtaaacctctcatccacacattttactgcctgaatctcttaactccctttcatatagacccttcctgactagtaaatactatagctagcgatgactacatttttcaggaggttgaactgtgataggaaatgataaccagagaagggatagcatagtggggggaaaaaaccttgaacaagtttacaatataaagaaaaggagtcagtagaaaaaaaaaagggagatgttaaaaacaaaataaaggaaataatttgattccagagcaggtaggaagaaatggaatccagagcacaggtaaaatgataatcttaggcatagagacactcctgctgaggcgggaaggaggaagtaataataggtcaagtgcatacacatttgtaggaggagacatgaactttaagaattccaacctgatgacttctatttcctggagtagtagggaggccaagtactgagaattaaagtggaaatgatggagtactgatgggaggaggctcatgaaaatttcaacatgcttttgtggaaaatggaagagagagtagtctaggaaaaattgagattatcaaacaacgtagaggatccaagcaaaattggaagcaataaatatgtagaggcataaatccacatggatgtgagactgttatcttagtaatacttagcagtctacatgtagggaaatatggcccaaataagatctacatagaggaaaagagttgaattagtgtaggtaaaattgaaataggaatggattccaatgtcccaggggagcatgccatgcttgaaaaactatggtagtttgctatagctggaagcatagtatataagactaaaaagttaatcaaggacccaacaaatgatgtttttatacgctttggcaatggaaatccactgaagggttttgaactggagaatgacttgatcgcatctgtgttttaaaagcattactagaaaatatctatggaggggggaatagaaggaatagacaaatggcaaagaggccatttaagaggttatttaacagtatagatgggaaggcttgaacaagggcacagaagtggacatgaaaggaagaaatggattagagagacctacagagatgattagttgaggatagatttgtgaaaacttggtgactaaatgggattttaggttatttgaatttcatttcttcctcacagattcttcttccttactcccctctgcagatgacccttcctttgacagaagccaaaaagctagtactaattgcatataaaactcataaagtattattgaaagttgaacagtataattgaaagagtatggacttaggagtttcatgttctaagccctactccaccacttaatatcttcatgatttggcacagttaacctcactgagcttcagtttcttcctctgtaaaatgaggatcatatctattttccagagctattgtaaggtttaatgaaatactgcaaacacgtatagaaagtagtttgcttgaatgcttcctggtacgtaatagatgttcaaatggtagttagttctgtttccattatttttattactcttagtatctttgttattatctcagtgtccatggagtgctttttccagattctgctgtcccctccaaggctggtttcatcatgtttcatcctgcccctgccttctcttcactgaagtcataccaagtcacactgtagataggtgactccctaaatattgcccaacaagccacatagtgtcaggaaccctccctgactccagtccaatcattgagccagctggccctaggttcacaccaatggcagaggctgtccctcaaatcaggtcgaatttggctggacaaggaaaccaaccacacaaagatggcctctcagatcattcgtttaactattgccataaatggacacataaacctcctatcattgcgtgtgtcataagtgaatatattatattctcatatgctatgttctcatacattatattctcccaggcatgcctcatgtccaactacctgaaaacatgccaactggaagaagcccctcaaatctcaacacataaggagtgcaaaacacaaaaacaaaatcttagcagccaaggcccctctgactgaatcatggccagctgtctttaaaataacgtatgccaattttatgactgcctacagagattgccctgcaaataaccttgggtaggtggttgtgcctctaattataccccgtaagtgacagaaatcatgctgcatcatgactgtcttcaaattgcagaaaaacagacctaattaaaagagtttcctgatggccgggtgcagtggctcacgcctgtaatcccagcactttgggaagccaaggtgagtggatcacctagggtcaagagttcgacaccagcctgaccaacatggagaaaccccatctctagtaaaaatacaaaattagtcaggcatggtggtgcatgcctgtaatctcagctacttgggaggctgaggcaggagtatcgcttgaacccaggaggtggaggttgcagtgagcctagatcgcaccactgcactccagcctgggcaacaagagtgaaactctgtctcaaaaaatattaataataaaataaaataaatttttaaaaaaagtttcctgttttcctctgaataagtccagtatggtccttttaacagaagcagcatgtttgaggttctctcctcaagaatctaccaagttgttgttcaaaaggattattttcccagaactaaggatcaacttttagtgataacctgacatgggggtacaaaacaaatcgtgcacaaaaggagaccaaaatgtcaggcattttccagaatttccctttggcatcagccctatggtcttaaattgataagagctctagtaagacctttttgggtgctctttaccctacaatcttcctttgcccaagctagaactagggtcagtggcattcttcatgctcacgttttcctaattatactgtagaaccactaccaaattgctagaattgggaccaagtggaatagtgagaagaggggagaaaagtggtctatttaacttcatctcacccttccaaaatccacaaggcttctctcatggacaaagatttcacataatggggacctttacaaagagtgagcagtctgcttggctatgataggagcaaagagttttaagcaacagattaggaattcacatttgggtaaaagcaggtagaacctctgttagcctggagacttcaaggacgttgatgacagcagtacacatgcctcttactatttgaaagggagccgaatgtctacggaatgtagtattaaaagaaactatttagtaattttaatacatctctgtaaacacacgtaattccacaaggctactctcagaggcaaggacgggaagccgtagcaaggaatgtctctattctagtcctaagaagatttgtgtcgctttcccataacctcaagtgtttacttgctcttgtaataaatcaggcctagactatcactgcctaacaattttccagtacgcgtcactttcatttcagctcctgctagtgtaccatgcaaagcacctgtgcatagtaattaattttaagcatttatgcatgctagtaaacaattctagcacaactttgtggttgtgtttcactattaaattagccctttttgttttgctgaagtccacatgtgtgtttatgtatgcatgtgtttacatgtatctgtgtaaacaataagtaacaagcaaaaacaagccagtgtcctacaggaacgagagcagtgagttttttactatgtgtacctgtttaccctcactccaggctaaattgtgtgcccctgtgttttaaagttaaataactataactacctatgaaatcacatagcacttccactttaggattatcaaacgtctgctagcattttcttaatatattcgatgcagtagctggatcccaggaattcacctatgaacactgaaagattacttctgatggcagacatgaaattagttgctccaatttttgaactagatggaaccaactggaatagactacagggtgagaatatacatgtgagtttgagtgaatatgtcatttaaacctaatttttgtctcattttcaggcagttatatagaatttcgcttaagaaatactggaacataactgggaccttgaagaaactaaagggtttgacagcataattgaaatggcaaagtctgctttcatctttagtttctctagtgaaagaagtgactctatgtctccctgaaagcccaaattggagaacaactaggtcccccagaactggtccagaaaattagggataaagaagtgccatttttcagtcctacatcaccattattcaatttctagtggttagacaaagtgtacccagcatggaattttgaaaggcaggcagatgagcctcctccacagctttttgttggtctacctctcgtcttctaaagaatagtgtgctgggggaagtagctaaaaatgaaaaacattgaacaaagggtcacaagttacaattgtattaaagactttgagtcagataaggccactttgagtcagataaggccaagtactagctggaaacaaagaaagtaagagactgacaacatgagcagtttaccatgaccttctacttagactctgggataaggtctctgtgacgggtactcactgaaaattgagagacaaagaagtaaacagttataatttggggtggaaaatgctgtgaaggaggtaaatgcaggattctacaggattacattgacacctaccaccaacttaaagaataacggtaagcagggagggcttcttttaagatacgacatctgaaatgagtttctaaagacaaataggatttttcctgatgaagcagtcattgcaggcattacacctggagagaaaatattctgtccaaaggcatgaaggtatgaaagaggagaagcatgtgctaactgcaagtagctctgtttggctggactgtaaggtctgaagtggtgaggaagagatggaaagatagggaggatagtgcataggaaggtaacaggctgcagcagtgagccagagccggatcatgaaaggccttctgtgacactatactgggagctgcgtataggccatgactcttaatagctaagcttcatgggaacagaaactatgtatatttcatttgtgggttcatccccaatttctctaacattgtacatagcacaaaatagaggtcccaatagcagcatgaatgaattccatgccaaagcatttaaacatcatcctgaaggctaagaagatcattcaatggtttcaagcatctagggacatcgctagatttcaattttatataggctgtggttgaagggtggagaataaatgggaggggttaacactggatgtgagaagcaggtctataaggctattgtagtaatccaggcgagagaagatggtgggcagggatgggggatttggaaaattgggtaaatttaggaggcatttagcaaattgcattaacaggacagggtaactgatgagaaagaagatggaaagaagaatgtgtcaaagatgatactaccagtttgatgatttgaacaacaaggtggtactatttactgaaattgggaatattggtaaatgagtgagtttgtgaggcagagaagggtatcattggtggggctatggcatcggaaaggggtgtgggaaaattggaggcaaggagagtaaggaaaatatcagtttcattttggaaacattgagtttaaggcatctgaaggatattcagattactgtgtattcagtacccagttgactatatatctgaggctcagaagaaaaatctggaaatatagatacgggagttgcatatagatagcagttgaaagtatatgtcccttttggttggctccttttttgttgctgttgtttgttttgagaagaagtctcactctgtcacccaggctggagtgcagtggtgcgatcttggttcactgcatcctccgcctcccaggttcaagtgattctcctgcctcagccctccaagtagctgggattacaggcgcgcaccactacgctcggttaatttttgtatttttagtagagacgaagtttcgccattttagccaggttggtctcgaactcctattctcctcccaaagtgctcagattacaggggtgagccactgcgcctggcctggttggctcccttaatgactccttttataccccggcccagtgagctctgcctaaaagctaattcaccacaacttgaattcctaatgagtatttaatcttcttcctaatgtcttgtaacccagcccaggccccagcggtaccatctaatgaatccctcaggagactaagattccacatcctaaagttagtgccgcttgtagccacagctctcagcttctaacagcacaagggtgccctctagtgttcagcatgatgcatacaggggcacagagaactctgaattgtgaacctcgcctttcaaccaggatcactgccctgccaccttcacttctggggaaattcactagccacatacaacctcaaatttggagggactctaagtacttcagattctagcagggcatgaagagagtcaggcaagccgtactctcttaaggcaatgtattttttcagttgcccatcacagttagggagtagcctgtagtgtcatctcttgagtagaaccgtctaggttctcagtaagcctcagggggaaaactacaagatagattggtcagagttatactattatttcagaaataataagccacagagtgtagatacatatgtgtctaccaaactagagaaacacaaggacccatgccacaggcctcctggttgcactagtctcttaatatatcctacagcagggttaaccactttgtccacaggtgccactcccatcactagaaacttttgtatactaaccagggagccagggtgaaagtggaaggatcatcttttacccttacctacaaagggctgtgggaagggcagtacatcataaggaattctgggtggtacactcacctttacactagtgaagagatccccttgttcatatagcagattaggaagaatagagatcctcctataggatcggtgtgctcatgagataacatgcaataggaatcggcgtgctcatgagatgagataacatgcaacaaaaccccagtattactactgtgttactgcttctactcaaccctctacagagtggagatccaagtgcctacctcactatagcctaagaaaacctatgccctaaaaaagaacaaaatcatgtcctttgcagcaacatggatgcggctggaggccatcagcctaagtgaattaatgtgggaacagaaaaccaaataccgcatgttctcacttataagtgggagctatgcattggctatacatgcacacaaagatgggaacaatagatactggggatcccaaagtggggggaagggagggggcaggggttgaaaaactacctattgggtgctatgttcactacttgggtgaagagatcattagaagcccaaacctcagcatcacgcaatatacccatgtaacaaacctgcacatgtaccccctgaatctaaaataaaatgtttttagaaaagaaaaaaaaagaaaacctatgcttttcatcttattttgcaactctgccttaagttctaatatggccctccaccatctgtcatttccttacctaggattccaaacaaatatgccaattaccagaagacattttcagaactgaaggcagaactgaaagtatgattaacctgagtatgatgtcaagcacttgaattgtttcgctaaggctaaggtcaagtcctttcaacaatatgtagataataactatggcaaacttacatcatgtcccagtactagacatatttatttatgaaatggctgcctattccaatcattacctcagcatcacaacaataaaactttgcccatacctattgactcagggcctcccagatcatcatggcaaaccataagtttgtttttaatcatttttggagtttgtttgcatataataacatttacccattttgaatggactttataataagcactgacaaatttatatacctcctggaaataacaactgccatactcaaaatacaaaacactgtcatcacctcctcccaaaattcacttctgcccatcccagtcacccagagacccacttcaagcctaaggcaagcagtattttttattttgtcatcaagaatagatttgccattcctgaagtttcatataaacagaagtatacatgatatcctcttttgtgtctatcttaatttaacaaaatgttcttgaatttcatgttcaagttaaagttatatcccactgtggttttaatttgaatttcccaaatgactgatgacgttgagcatcttctcatgctctcagtgcacatttctatttttttttttttttttgaaattttgaaccattgtttttatgaaatggatttgtctacagcatgaatgagactgatgtgtggaagatggtagctcacatgtgccacaagcaatatttttttgctgtttgtcttattcagtaccctatatattttcagaaacagatgaattaaatcccatatgacctcatcatgaaatcatggtatccttttttttttttttgagacagagttactctcttgtcacccaggctggagtgcaatggcgcgatcttggctcactgcaacctccacctcctgggttcaagcaattctcctgcctcagccccccaagtagctgggattacaggtgcccgccaccatacccggctagtttttgtatttttagtagagacggggtttcaccatgttggccaggctggtcacaaactcctgacttcaggtgatccacccacctcggcctcccaaagtgctgggattacaggcatgaaccactgtgcccggccaatgatatcctatattctattccttataatgagattacagagtttcctggccacttgatatagcaccacttttggaataaccctgcaaaaggcctacttaaaagttgaaagatagaattattggaccatgttctatatattccatatgatgaaggcacataattgcctattatgcatcaatcacattaaacttaggaacactccaggtaaatgaagtttgtcctgagatttctggcatttatcaggttctacccacagttcattacttatgttatttttctagttagcctgataactgatttcaagaaagggacagaatttgtttcattggcaattttacttactgggctgtaggtttgtgaaatagtgatcctctcagcccttagaacggccatgaagacctatggcattcagagcatggggtaagttgccttcaactttgaataatcttgcccatttccttagtataccatgtacacaccattttctataagtgttaaaacatgaaattttggggagcactaatttagtcctctgtcatagatgtagccatccagcacatgaaggtactattttctaccctaattctctctcctacacctaatcctccctggccctaaaaccagcctactccaacctagcaaattctttatttatttagtttttttttactattatactttttaagttctgggatatatgtgcagaatgtgcaggtttgttacatagctatacatgtgccatggtggtttgcttcacccatcaacccgtcatctacattagatatttctcctaatgctatccctccccttgcccccaccccctgacaggccccagtgtgtgacgttcccctccctgtgcccatatgttctcattgttcaactcccacttatgagtgacaacatgcagtgtttggttttctgttcctgtgttagtttgctgagaatgatggtttccggcttcatccatgtccctgcaaaggacatggacacgttcttttttatggctacatagtattccatgatgtatatgtgccacattttctttatccagtaaaatattgatgagcatttgagttggttccaagtctttgctattgtgaatagtgctgcaataaatagacgtgtacatgtgtctttatagtagaatgatttataatcctctgggtatatatgcagtaatgggattgctgggtcaaatggtacttctagttctagattttttttttttgagatggagtcttgttctgtcaccaggctggagtgcagtggcggatcactgctcactgcaacctccgccacccaggttcaagtgattctcctgcctcagcctcccaagtagctgggactacaggcatgcgccaccatgcccagctaatttttgtatttttagtagagatgaggtttcaccatgttagccaggatggtctcttgaccttgtaatccacccacctcagcctcccaaagtgctgggattacaggcatgagccaccatgccttgcctgtttcctgactttttaacgatggccattctaactggcataagatggtatctcattgtgattttgatttgcatttctctaatgaccagtgatgatgagctttttttcatatgtttgttggccgcataaatgtcttcttttgaaaagtgcctgttcatgtcctttgcccactttttgatggggctgtttggtttttttcttgtaaatttgtttaagttccttgtagattctggatattagccctttgtcagatggatagattgcaaaaattttctcccattctgtaggctgcctgttcactctgatgatagtttcttttactgtgcagaagccctttagtttaattaaatgccatttgtcaattttggcttttgttgccattgcttttggtgttttagtcatgaagtctctgtccatgcctatgtcctgaatggtaatgcctaggttttcttctagggtttttgtggttttaggtcttatgcttaaatcttcaatccatcttgagttaatttttgtataaggtgtaaggaagggatccagtttcagttttctgcatatgactatcctgttttcccaataccatttattaaatagggaatcctttccccattgcttgtttttgtcagttttgtcaaagatcagttgccaacctggcaaattcttatactgtgatgaaaaatgtctccaactacatagtgatgaccatcatatcctcagaaaatccctgatttggggaacatccacctaaacacctatttgtttaagaagttagcaagacacaaagtcaaccatattttatgggaatgagaatactcaccaccaaggccttctttgggacttagaggtgatactacactcagaactccatagctaagagcagctaaggcaaacccagaagctcagtttgtaccaggtattcattctagaagtattactaagcgcttagagtgtatcaggcactggtgcaatgcttgatggaccacattcacagaattttttggtcttactaggctgcccaaatcaccaggtcttgagggcagattatctcctttagcaagtcctccctggcagattatccaaactatgaactttaaggccatctatttccaactataattaatcagaataatctggcagaggaagtaggcaaacacacaggcatactgatgccagactgaaagtcaaatatacccagaaacgataatgtaaagtacagaataacaggctgactcccatttagggaggcctgtccttaaatactgtgcctatgcaaagacatttatgtctggtgattattcaagatattgattaaactctacagagacttttgaaggattcatgtttattactgcatcctccaatagaatagcatctagaaaacctgtagttagaacaagaaatacctttagcaattcagagaaataatacaccactcactgtccctatatgtgtctctaggattccagaacattaaaatgtatctttaacttgctccctttccactgccataacttcaacctggtgattatgtaattattcactaaaatggcacattttatccatatgctggttctttatccattgacattaacataatactacaactgaaattagtgagctattttgttttcagaaactctgatgttttcaactatgacaccaagattgaagaataatattgaaggccttttgtaattgcatctactatacatggctaaatgcagcacaaccagttttttgaggaatacttcttctgttctgcttacagacaactcaatagttcaacctacttcgtagagtttggctgcaacataaaacattcacatgaaacatcctcttcaaagaaaccattattatactagaaaagaaaaagaatctcaggaaaatagaaatggacaggaacttccttaacttgccaaacaatatctttgaaacatacaggtcatattattcttaatattgaaagactgaatgcttgttcttaaaagcaacctcaagagaaggataactattcttgccacacctattcagcgtagtattgaaagttttagatagtgaaataaagcacggctagaaaattaaatttatgcataggagaaagaaagaaacaaaacagtccttgtttgcagataatatgattgtctacatagaaaataccaaggaaaccataaaaatctcctagttagtaagttgcaggatacaagatcaacctacagaaatcaattgtatttttatatgctagataagaacaggtggatacgaaaaataaaaaacataatgccatttacaattgctcagaaagtggaagacttaggggtaaatctaacaaaacttgtaaagaaattacaagctgaaaactacacaatgctgatgaaagaaattttaaaaatctaagtggataaatggaaagacatagtatgttcatggacttgaagactcaaagcagatgtcaactctacccaaattgacacacatatttaatgtaattcctgtcaaaatccaagcaaaattttgtatatataggttatgcatatatatatgtatatacaatagataagtaaatatgtgatagagatagacaatatacctacaaaaatgcctggattttggtacgaattattgcaaaatttgtatgaaaagtcaaaagactcaaatagctaaaaacagttttttaaaagtacaaaatgggaagactcagtgtacccaatttcgagtttattatataactacagtaatcaagactgcatgatattgatagagtgatagacacatagatcaatggtgcagcacacaaaacccagaaatagacacacacaaatatgaccattgattttcggcaaaggtgcaaaagcagttcaatggaggaaagatagcattttcaacaaatggtattagagcaattgaaaatccatagggtaaaaagtgaacctcaaccaaagactcataccctatacaaaaattaactaaaaatgtattatggacttatgtaaaatgtaaaattgtagaacttttaggaaaaaagcacaagaaaagctttggcatatagggttgggcaaagagttcatacacttgatacgaaaagcacaatctataaaagaaattaaatgatagtttggacttcatcaatattaaaaactttggctccatgaagaaggataaaaaaactttggctccatgttaaaaggataaaatacagtctatagagtaaaagaaaatatttgcaaatcacaaatctgacaaaatacctgatatctatagtatatatagaaaaaataagcaatccaattagaaaataatgaaaagacatagacctttcacagacaaggatatacaatggtaaataagcacataaacagatgtaaaacatcattagtagttaaggaaatgcaaattaaaagcacaatgaagtatcattacacaccaataagaatagataaaataaaaataattacaactccaaaagctggcaaggatatagaggaattggacctctcatgcatacttgatggggatataaaacagtagagccactctgaaatagaatttcaaagtttcttaaaaatgaaacacaacccagcaattgcccttctgggcatttatcccagagaatgaagccttctgttatgtagacacacacatgcacagctacttgtacacaggtgtttgtagttaatttgttcataattttttaaaaaactgaaaacaacccaaatgtccttcaataggtgaatgcaatgagtcaatgcaacgggttatgtgactgtggtgtatccataacatgggatatttctcagcaatggaaaggaacaaactgatacacacaacctggattagcctgtagataattatgccgagtgaaataaccattccctaaaagtcacatactgtatcactccattcatacaacaatcttgaagtgacaaattatagaaacggaaaacagattagtggttgccagaagttaaggagctgatgagagcaggacggaaactagcatgactacaaaaagacaacatgagggatcctcatggctatggaaatgtttcaaatctttactatatcaatgccaatatcctgtttctgatattatactacagttttgcaggttgttaccattggagaaaattaggtaaaggatgaatgagatctgtatgtattttattttgccactgcatgtgaatccaaaattatttcaacataaatgacttaattaaaaataaaagtatccattaaatatccataaaattgatacacctttagctagactgatcaaaaaagagataattcacaaatcaccaatgtcaggagtaaaagagggaatatctaccacaaaggccacagacatcaaaaggataataagaaatattattgtctcagtaagattggttgagctactataacaaattaccatagactggatggcttacgcaatgaacatttatttctcataattctgaaggctgtaaggtccaagatcaaggtgccagcagatccagtgtctgctgagggccagtttcctggtttgcaaatggccactttctgcatatacccttatgtcttgtcttagaagaacactaatcttattcagaaggactccacccttataatttaattacttcctaaaagccccacctcctaatatcaacacattgggggttaggttttcaatatattgatttgggcaggacacaaacatttagtctataatattctattcctggcttcaaaaagtcatgcctttctgacatgcaaaatatattcatttcatcccaacaaccccaaaagtcttaactcattccagtgtcaactctaaaatctggagtccagagtcttgcctaaatatcatctaaatcagttacgggtgaaacttgaggtaagattcatcctgaggcagaattcttctccaggtgtaaaccagtgacaccaaacaagttatgtgcatcccaaatacaatggtagggcaggcatatgatagacattgacaaaatagaaatttggtgggggcgaggaaaataagaaggaaggagtgatgggctccaggtaagtcaaaaatctagcaaagaaaactctatgaagtcttaaggcttgagaataatcctctttggtttgatcctctgtcttctggacccactgcagcaatagccctgcctccacagctctgctgagttggagttaagtgcccatggctctgcctagcagatgttatgagcccacagtgagattatacgaacattggttcagccctttgggactgaggtgaagaagacctgcctcccaggcctgtgcattctgggcctgtagtgggagtcatagccctgatgatctctgaatcaccttttggggtttctttccttgtctgaagaataatgcatgtccacagctggaagagatgtgtgatctgggtctgtaggcgctaagaagtctgacagtcttcttttacttggtcctattttctgttttcttcagtcaaagctggcagtgtttctgctaacataatgccatctctattcctggcttctgctgagattgctgaataggtccatgtttcacacctgcactaatctccttaataaatgattggtctaccacacctgtagtgttttcttctgaactcactttctcattttttgttatgcacaggctgacaattttccaaatctttaagttctgataactttttgataagtaattgtgtcttcaattcatttctgtccccttgcattttactataagcaatcaggaggaaccaagccactccttagacgctttgtttagaaatttccttggctaaatatccaattttattgttcacaaactctaccttccacaaaacgctagaacacaaacataattcagccaagttctttgccactttataacaaaaaaaatcacctttcctcctgtttccaataatgtgtccctcatttccatctcagacctcatcagaatggcctttgccatccacatttctatcaatattctgttcatgattatgtatacattctctaagaagacaaaagttttctctacagatctccatttttctttctgagctatcactggaatcatctttaaaaatctcttcacagcaattctggcttcttctagcatgtacctctaaaccattctatcctcaacccattacccagttgcaaagccactccacatttttaggtatttgttacagcagcagaaccccacctcttagtaccagtttctgtctcagtcagttcagacttctataccaaattaccatagactggatggcttaagcaacaaacatttatttctgacagttctggaacctggaatgtccaagatccaggtgccagcagagctggtgcctgggcccacttcctggtttgcagacaactgttttctttttagatcctcacatggctaagagcagaaagtaagaacaagctctcatgtctcctcttataagggcactaatcccattcagaaggactccaccttaatgacctaattagtttcctaagacaccaccatcagataaatagcaatcccccatgaaatgtttcaaaaaaattagaagtgcatgctttgaaataattttatgagtccaacataacactgcaactaaaatcagaaaaaaaggtatttaaaaatgaataaaactgtagatcattttgcacttatccccatgtatacaatactttttaaatactggcatattatatacaagaagaaagataaattaccaaatgaagtatattcaagaaatgaaatatatgctggtaagcaggctctctggctttcagactttgtctttatttactatctaatcatgttcagtttctcagtatctttctccaaaacatcaataaccccaataataataatccaatttcttagccttcatgtttattatgtcccccgtgcctctcaaacatcaaagacattgtacctactagtatatgccttgcattaatgctccatcccagttcaccaccagtacaagtttcaacaaatgcatgacagaggatattagtgttttacctaccatcagtgaagggtccttctttgtcagaaggtcagcaagaattaagttggaaatcccattacagtgctgcttcccaagtctaacccccacaagatgggtgcctcaaaaaacagaatctgaaaaaagaatttgcatataagaaatgtattggtggccagacgcagtgactcacacctgtaatcccagcactttgggaggccgaggtgggtggatcacttgaggtcaggagttcgagacctacctggccaacatggtgaaaccactttcctactaaaaacacaaaaactagccaggcatggtggcgggtgcctgtaatgccagctacccaggaggctgaggtgggaaaattgcttgaaccccagaggcagaggttgcagtgagctgagatcctgccactgcactccaggctgggcaacagagagagattccatcaaggagaagaagaaggagaaggagaaggagaaggagaagcctatcaatcctatggagagctctagaactgggatgaatctggaaaggtgacccacattgagacaagggggctgggcctttatacttttatactccaacttgaaccagtgaatggacacaggcttcccctgaaagggaaatcataatatttgaagaagtggctccaattgtctcaaggaaatttttgaggagagattcagagattcatctatgagctgtcagcatgcaacactattggcagctggggtgataggtgtcttagtcctgagagggaagagagggcatatgggcagtacacacagcatccactactactactacacacacacacacacacacacacacacacacacacgcacacacacacatatacactgtatatacatagtatacatataatcattgtatatgtatatatgtatacaatgtctgtatgtatcactgtgtatactgtatatatatgtacacactgtatgtataaatataaacatatactttgtgtgtatatgtatatattcaacaacatgcttattagtgtaacaacctgcttcatcccttcttcaatacacttttgccccactttcattcatgtccatatttctagcctcatatcctgttctaattccttgtttatgagctagttctgactgcttccacatcagatctaagatatctctgattaattgggatccatggagagggtgtcatcatcattctcggaagccttagtaacatagataggaataactcaagtttacataaaccccccaagatagatgtctaccaaagtcctgcctttacaagtgctctatatgggtttggagtgaatctaacagaggccatatccaagagacagtatgtttaatttgtagagttttgagacttgtctggatccaatgagagatttactcagggcagcctgaaggagaaaagtgaagaagagtttaaactatggtcaatgagagaagctggaaatcagaaaagccagaaaaagcagcacccataattgaaactgaggagtaaggcaaggtcacaaacatgaaaacaaaggaaaagtttcttgcagtaacaccagttggaacttctcatcattaactgtatttttcctagaaatttctacagaaaataaaataagaatgctgtggtcaaaagggcagagtattcaaacagaaagcagaagaaaactgctttctctgtccagagaaactaagctccgtcacttactaattatatcacatatggcaaatcacttaacctatctgaggccctcatattttcttcatatctaaagtgaggatatgaatataggtacccatttcctgaaaaatttttttgagactcaatgaattaccaaatatgaagattttggcttcatagtaatgtctgctttcagagagatctataagatgcttctcgagcaggggacctgctggaggactcccctaaatgtcccaaggaagcagaaaaccctgaaggggagaagaaggaggcagccaccttggaaggtgagaagacacttcttgtggaggtggaaaagaatagcaccctctctgagcccggctctggccgggggcctccccaagaggaagaagaggaggaggaagaggaagaggctgccaatgaagatgctgagaccccaggcatcagagatcatgagagtctgtagccaccaatgtttcaagaggagcccccaccctgttcctgctgctgtctgagtgctactggggaaactggccatggcccgaaaactgggaacccctttcccaccccaacctgctctcctcttccactcactattcccactccaagcccagaccatggagattgacctggatgagacaggtcacctggccctcccctctaggtccccatacccctattatcagagtcagagccatgtcttctgctccctgggaagagatgaggctattatgttccttccacttggagctattttccaggcttctgctggggcctgggccaactgtttccacctcctgacatcctttccccactctcttagtcattctgggactctgggttgggatcaggggtgggaatagaaaagatggagcataaacagcagtgtgggcttgtggggcctgggaggggcaatcctcaaatggaggataggggtagcacaggagggtggcatcttcctgagctcctgtcccctgctacacctattatcccagctgcctagattcaagtaaagtgggacagcttgtaggggaggggctcctttccataaatccttgatgattgacaacacccattttttcttttgccaatcccaagagttccgggagttgtagtttatcatcaaaagattttggggcttccaagttgtttgggccaaggacctgagacctgaaaggttgactttacccatttgggtgggagtgttgagcatctgcccccatttagatctctgaagccagaaatgggatgcttgggaaggcccctagctgcccttttccctctctgcacagtgctgaaggccagcttatagtcatatatatcactcagatgtaaaggaaaagatacattttttaggaaatgtttttaataaaagaaaactaccaaaaaaaaatgtaaagacccctaaccctttgtgtgctccgcattctgctccttccttccccatcgttgcccacatttctgaggtgcactgggaggctcccctactatttagggctttatgactttctttttgtagctggggctttggtgttccttccagtgtcatttctcatccacatacgctgacctgttccccttagtgttgtcaccagatccgatttgtaatcaactgagaggacagagggaaataagtgccctctcccaccctcttcctagtggtctctctatgtctctcttcagtatctggtctcttttaccctggcacctctcccttgggctctgatgaaaaattgctgactgtaactttggaagtttagctctgagaactgtagatgatttcagttctaggaaaataaaacccattcattaccaaaaaaaaaaaaagaagaagaagaagatgcttctcagcacatcgaatcaccctgggccatccacaaaaggcacaccttttcagtttgcattcataaaaattaattcctgaatgacttctatgccttttttttttttttactttatttcaggttcagggatacatgtgcaggtttgttaatacaggcaaacttgtgttacagaggtttggtgtacagaccatttcatcacgcatgtactaagtagagtactcgatagttatttttcctgatagttatatctcccttctgccaccctcctccctcaagtaggccccagtgtctgttgttcccttctttgtgtccgttggttctcattatttagctcccacttaataagtgagaacatgcagtatttgggtttctcttcctgagttcgtttgctaagaataatggcctccagctccatccatgttcctgcaaagaacatgatctcattctcttttatggctgcatagtattccatggtgtatatgtaccacattttctttatcaagtctatcattgatgggcatttaggttaattccatgtctttgctattgtgaatagtgctgccgtgaacattcgcatgcatgtgtctttatggtagaatgatttatattcctttgggtatatacccagtaatgggattgctgggtctaatggtagttctgtttctagttctttgaggaatcatcacactgctttccacaatgattgaactaatttaccttcccaccaatcatgtataagcattgctttttctctgcaaccatgctagcatctgttatttttctactttttattaatagccattctgactggtgtgagatggtatctcattgtgattttgatttgcatttccctaacgattcatgatattgagcattttttcatatgcttgctggccacatgtatgtctttttttgaaaagtatctgttcatgtcctttgaccactttttaatggggatgggtttttttttgtaaatttaagttccttatagattttggattttaaacctttgtcagatgcatagtttgcaaatattttcttccattctgtaggttgtttgtttgctcagttcatagtttattttgctatgtagaaactctttcgtttcattagattcaatttaccaatatttgcttttgtcacaattgcttttggtgtctctgtcatgaaatctttgcctggtcctattccagaattgcattgcctaggttgtcttccagggttttatagttttgggttttatatttaagtctttattccatcttgagtttttttgggttttgtttgtttctttttgtttttgttttttgagatggagtctcacccttgtcgcccatgctggagtgcaatagtgcaatctcagctcactgcaacctccacctcttgggttcaagcaattctccggcctcagcctcccgagtagctgggactacaggtgcctgccaccatgcctggctattttttttttaatttttagtagctacaaggtgtcaccttgttggccaggctggtctcgaacttctgacctcaggtgatccacccaccttggcctcccaaagtggtgggattacagacatgagccaccacagccagcccgtcgtgagtcgtcttgagttgttttttgtatgtggtataaagaaagggtccagtttcaatcttctgcatatgactaaccagttatcccagccccagtactttccccattgcttgcttttgccagctttgtcgaagattagatggttgtaggtgtgtgaccttatttctgggatttctattctgttccattggtctctgtgcctgtttttgtaccagtaccatattgttttggttactgtagccctgtagcatagtttgcagtcagctaaggtgatgcctctagctttgttctctttgcttgacttgtgtatctcttgtagtagcttggtctcatggttctattaattaactcttgtggtgctctcatgaggtctttttctgctcaactgcctcctcccaggctcaggctgaatttccttctttggtgaaagactctaggaatctcagcctgttttctcatgttctctctctctctctttctctctctctctctctctctctctctctctgcttctatcttctattttcatgtttagagttctactgccttccctccaagtgtggctttgatgcttcagttttcccctttcttgaatacaggatcttactactgtaaatgttttactgaagatcagtgcagaaaaataaaagacatgaaacataatataactcgaggagtatcagtggattacaagccacagaattctaataatcatttctctatcattccaaactcccttgtgggttgggtgttttctcccagtaagtggagtttcagaggtgcttccatcctgattgcctgattgccacttgagggtgcatcctatgatgcttgaaaccccatcttctcatcttgaatatggaacacaagcgtgttcccgaaacaagatatcctaaatatccctttctgcagtaggcagcaggtatctctgacctcagaaatatcacacaagtaacccattgctgactaagcctgtaagtattttattgctcacactgctactcatagcatgtggcttctctgctgctcagtttttccattttataataaaatttactcttctttctagctttcaatcttcctgctttatttttttattctgattggtgtcctacttcaattcagaagaggcttggccatttcaaagaccaaggcaagccctttggccttttccattcctctaggtattgtagcaccaaagaacaattggtcacaaacacaattctaatacattctctgggcacagccatgtacaagacttgagctggcctcactgcagccatctccagggaaaccagaaaaaaaatgtgcattttgagaagctggaggtcaagtccctctggcacatattttttccacaacgaatgacacaggtggaagtgacctaagcaaaagtcatataaactaagtcttagatggacctgcttctccccagcctacgatcaaaggtcaccctgagctttttcaacttcccacactactaccaactgacagagagctatcacaaactttcttagcctcactgcccagctatctaactttttaaattgaaataacaggtctgcagaattgatggacttttttctccatcacccaagcataaaattctctgacccaagggtccattcatactttcaaaaccaaaacaatattataccaaaagaattcacagaattgtgcactgttatgttgtacttgccccatcatatgtaaatatccttgggattgagctacaaagtgctataaaaagatacactatttgcagacactacatatgaaaatgcaatcagagattctttcttatattttatttttaatttttgtgggcacatagtaggtgcatatatttatggggcatgtgagacattttgatacaggcttgcaatgcataataatcacatcatggcaagcggggtatccattctgtcaagcatttatcctttctgttagaaacaatccaattacactcttttagttatttttaaatgtacaattaagttattggctatttagtcatcctgttgtgctattaaatagtagatcttattcattctttctatttttttacccattaaccattcccacctgcccccaaccccagccccctattgcccttcccagcctctgataaccatccttctactctctatgaacaagagacgaattttgatttttagattccacaagtaagtgagaacaggcgatgtttgtctttctatgcctggcttatttcacttaacataatgatctccaattcgatccatgttgttgcaaatgacaggatctcattgttttttatggctgaatagtactctattgtgtatatgtaccacattttcttttctttttaacagatagtttgaacttttatttatgtttaattttaatttttacaagatgtcgatagtagctggcttattaatgtacattattctttgatatttcaggaaggcacagtgttcaactgtgaactacagagtcctgaaagtttaaaatcagtttgtttctcaaccatgtgatatccaggattttttacaattactttgagatttttcctcatcagtaatgcaaagaaaattgcaatatgattatacaatttttttttattttttgagacaggttatcactctgtaacccaggcttgagtgcaggggtgtgattgtagctcactgcagcctcaaactcctgggctcagacgatcctcccccagcttcccaagtagctgagattacaggcacgtgccaccatgcctggctaatttattttttgtagaaagaggggtctcactttgttgcccaggctggtctccaactcccgggctcaggcaatcccctgcctgggccccccaaagtgctggaattacaggcatgagccactgtgcccagcctgatatacaatttctttctgagacagagtctcgctccgtcgcccaggctggagtgcagtggcacaatcctggctcactgcaacctgtaccacattttctttatccagttatctgttgatggaaatttaggttgtttccaaatcttacataatgtgaacagagctgcaacaaacatagaaagtcagatatctctttgatatagtgatttccgttcctttgggtacatactcagtagtgggattgctggatcatatagtagctctatttttagttatttgagaaacctccaaacgcatctccatagtagttgtactaacttacattcccatcaacagtgtttgagggttcccttttctccacatcctcaccagcatttgttattccctgtcttttggacttaagtcattttaactggagtgagatgatatatccttgtagttttgatttgcatttctctgatgatcagttatgttgagcaccttttcatatacctgtttattatatgccttcttttgaggaatgtctattcaaatcttttgcccattttttgaaaggattattatatttttttcctgtagagttgtttgagctccttatgtgttactggttgttaatcccttgtcagatgggtagtttacaaatattttctcccatgttgtgggttgtctcttcgtgttattgattgtttccattgctgtgcagaagccttgtagcttgatgtgatctcatttgtccatttttgttttggttgcctgtgtttgtgagatattgctcaagaaattgttgccgagaccaatgtcctgggaagtttggccagtgttttcttgtagtagtttcagtttgaggtcttagaattaagtctttaattcattttgatttgatttttatatgtggtgagagacaggggtctagttttcttcttttgcataaagatatccagttttcccagcactattgtatcaaagagactatctcttcctcagtgcatgtttttggtggctttgccaaaaatgagttcatggtggctgcatggatttgtttccaggttctctactttgttccattggtctatgtgtctgtttttataccaataccatgctgttttgggtactagagctctgtagtataatttgaagtcaggtaatgtgattcctccaattttagttttatttgctcaggatagtttaggtggtcctgggttatttgtggttccacataattttaggatagtttattctatttttgtgaagaatgtctttggtgttttgatagggattgcattgaatctatagattgctttgggtagtatagatattttaacaacattgattcttcctatccatgatcatggaatatcttttcattttttggtgtcctcttcaatttctttcatcagtgtttcataattttcattatagagatcttttacttatttggttaattcctaggtatttgattttatgtgtggctatagtaaatcagattacttttttatttctttctcagattgtccactgttggcatatacaaacgctactgatttttgtatgttgattttgtatcctacaactttactgaatttatttatcagttctaattttttttgtggagtcttcaggtttttccaaatataagactatatcatctgcaaacaaggataatttaacttctttcattccaatttggataccgtttatttctttctcttgtctggttgctctagctaggaattccagtactatgttgaataacagtggtgaaagtgggcatccttgtcatgttccagatcttacagaaaaggctttcagtttttccccattccatgtgttactaaccgtgactctgtggtatatgacttttattatgcacagaaattctgagtggtttgcacctagtgcaatatgttcaagtatgtagaaatttattatccacataccaggagggtaaagaaagtctattgagaaccaaagacctatgatactctcttatgatccccaagggttcctgcattatcgtttcactggactctctattttaattcagtctagggctatgttccactttttcatggcacatacactggtaaagactacgctttgcctttgtgtgttattttattagccaggatccttgaggaaaacagatgccacacatagactgggtaatttgataacagtttaataaaaagacttttaaggtaattaataaaagtgtgggaagaatttctaattaagtattctgttacggacaacagggaagagccattaccatgcctagtttggaagggttgggggggtggtcactggaatccagagaggatagcaaaaatgtaggtaacataacaagagccatgacagtcaccaggcaaaataaagtcaacaatgatgaccctttagggaagaatccagaagaataaatactctgactttaatttttccccacctcccaatattgtccccatggcttctgttggccaaacccaaccagggacagaaaaccaatgaggaaacattggacttaaactgtattttagacctaatagattgctaagatttcaaagccccctccaaaactcatgttgaaatttaattgccattgtaacagtatcgagagtaggggcctttaagatgtgattaggccatgaaaactccacccacatgtgtgggtttaatgcctttaaaaagagggcttttgagagtgagttcttactcccttgttcgtctgctttccaccatgtgatgatgaagcaataaggccctcaccagatctgagcccctcaaccttgaatttctcagcctccagaactataagaagtaaatatctgtttttaaatagattacccagtatcagatattttgttatagcagcagaaaactgactaagacagaaaattggtacagacaattttatgtcaacaaagttaagttgttatcagctaaaaataccctgttataaggttttttatgtaaggcttgtggtaaccacaaagcagtgtattttatgtaagccttgaggtaacccaaaagcaaaatcctatagtacatacccaaaagataaaaagtaatgaatcacagcatactactagagaaaattatttaattgtgaaggaatacatcaagatatgaagaaagaaataaagaatctgcaaaacaacaagaaaaaaattgacaagagagcggctggcaatatggccaaataggaagagctccggtctgcagctcccagcaagatcaacacagtaggcgggtgatttctgcatttccaacagaggtactaggctcatctcattgggactggttagacagtgggtgcagcctacgtagggtgagcagaagcagggtggggcattgcctcacccaggaagcacaagaggtcggggaactctctcccctagcaaagggaagcaacgagggactgtgccttggggaacagtgcattcctgcctagatactacactttcccatggtcttcaaacccacagaccaggagattccctcaagtccctacaccaccagggccctgggtttcaagcacaaaactgggtggctctttgggcagactctgagctagctgcaagagtctttttttttttttttttcgtacaccagtggctcctggaatgccagcaggacagaaccgttcactcccctggaaagggggctgaagccagggagccaagtggtctagctcagtggatcccacagccatggagcccagcaagctaagatccactggcttgaaattctcgctgccagcacagcagtctgaagtcaacctgggacactcaagcttggtgggggaaggggcatccgccattactgaggcttgagtaggcagttttcccatcacagtgtaaacaaaggcaccaggaagttcaaactggactaagcccaccacagctcagcaaagcctctctagattcctgctctctcagcagggcatctctgaaagaaaggcagcagccccagtcagggacttatagataaaactatctacaagtttatcaaaaagtttatttaaaagttcctggctgctggctctgaagagagcagcagatctcccagcatagtgctcaaggtctgctaagggacagactgcctcctgaagtaggtccctgacccttgtacctcctgactgggagacacttcacagcagggatcgacagacaccttacacaggagagcttgggctggcattttgcaggtgcccctctgggaagaagcttccagaggaaggaacaggcagcaatcttcactgttctgcagcctctgtgagtgatagtcaggcaaacagggtctggtgtggacctccagcaaactccagcagacctgcagcagaggggcctgactgttagaaggaaaactaacaaacagaaaggaatagtgtcaacatcaacaaaaaggacctccacacagaaaccccatctgatggtcatcaacatcaaagatagataaatccacgaaggtgaggaaaaaccagtgcaaaaaggctgaaaattcctaaaaccagaacaactcttctcctccaaaggatcacaactcctcaccagtaaggaaacaaaactggacggagaatgagcttgacaaattcacagaagtaggcttcagggtgggtaataacaaattcctccaagctaaaggaccatgttctaacccaatgcaagaaagctaagaaccttgaaaaaaggttagaggaattactaactagaataaccagtttagagaagaacataaatgacccgatggagctgaaaaacacaggacaagaacttcgtgaagcatatacaagtatcagtagccgaatggatcaagaggaagaaaggatatcagagattgaaaatcaacttaatgaaataaagcatgaagacaagattagagaaaacagaatgaaaaggaacaaataaagcctccaagaaatacgggactatgtgaaaaaaccaaacctacatttgattggtgtacccgaaagtgacagggagattggaaccaagttggaaaacactcttcaggatattatccaggagaactttcccaacctagcaagacagaccaacactgaaattcaggaaatatagaacacaccactaagatactcctcgagaagaacaaccccaagatacataatcgtcagatcatcaaggttgaaacgaaggaaaaaaatattaagggcagccagagagaaaggtcgggttacccacaaagggaagcccatcagactaacagcagatctctctgcagaaaccctacaagccagaagagactgggggccaatattcaacattcttaaagaaaaaaattttcaacccagagtttcatatccagtcaaattaagcttcaaaagtgaaggagaaataaaatcctttacagacaagcaaatgctgagagattttatcaccaccaggcctgccttacaagagctcctgaaggaagcactaaatatggaaaggaaaaagaagtaccagccactgcaaaaacataccaaattgtaaagaccatcgacactatgaagaaactgcatcaactaacaggcaaaataaccagctagcatcctaatgacaggatcaaattcccacataacaatattaaccttaaatgtaaatgggctaaatgctccaattaaaagacacagactggcaaattggataaagagtcaagacccattagtgtgttgtattcaggagacccatctcacatgcaaagactcacataggctcaaaataaagggatggaggaatatttaccaagaagatggaaagcagaaaaaagcaggggttgcaatcctagtctctgattaaacacacaataaaccaacaaagataaaaaaaaaaaaaagacaaagaaggacattacataatggtaaagggatcaatgcaacaagaagagctaactatcctaaatatatatacacccaatacaggagcacccagactcataaagcaagttcttagagacctacaaagagacttagactcccacacaataatagtgggagactttaacaacccactgtcaatattagacagatcaatgagacagaaaattaacaaggatagtcaggacttgaactcagctctggaccaagcagaactaatagacatctacacaactctccaccccaaatcaacagaatatacattcttctcagcaccacatcgcactcattctaaaattgaccacataattggaagtaaaacactccttagcaaatgcaaaagaagagaaatcatatcaaacagtctcttagaccacagtgcaatcaaattagaatccaagattaagaaactcactcaaaaccgcacaactacataaaaaatgaataacctgttccggaatgattactgggtaaataacaaaattaaggcagaaataaataagttctttgaaaccaatgagaacaaatggagaattgaaatataaataagttgatttatttctttaaataaatagttatacgcacacgcacacacacacacacgcgcacgcacacacacacactcttttcttttttgagaccaagtctcgctctgcatcaggctggagtacggtggcacaatctcggctcactgcatcctctgcctcccaggttcaagcaattctcttgcctcagccccccaagtagctggaattacaggcacacaccaccacgcccagctaatttttgtatttttaatatagatgggatttcgccatgttgccacattgttctcaaactcctgacctcaagtgatctgctggccttggcctcccaaaaatgctgtgattacaggtgtgagccaccgtgctcagccaataaataggtatgttttagcaagatgtagattgagattcctattgagatgtaaaattgcagtatgacacaatacgtacctcagacgaaagctttagttctttctccagtgggtcttgaaggtggcaagaaacatgtattatgaaataaatactccagttcagtgtctctgattattcagatggaatgtaaatgtgtgggaaattgatgggcttggggaaaagtgattataagaagttaggagtatatataaagaaatgaagagctggcagtaggacgtaataggttttgtaactttcctcacttagaaagggtgtaggattggttttagagtttccagcagccccagttttaagggatgtgtcagaagaaccagcttgcatcttgtactccatgatttacactggttagcagtgctaaccagaaagatccaaggaccagaaaattcaactcaagatcctcctgaagattatatacgttcatcctcgtatagaccaatgcctgatgtcaaaatggcattggctggtatagaaaatgcagggttgaaattcataatgactctgaaaaaggagaccctgtatggacaagtgaatgaaaatttataagctctttgagtagtatatttaattcatacacttcctctggaaattggtttgagggtttgaggtcatggatatttagattttaatttgtagggcttaaaagtgaacccctcaagccaaaataatttccatgtgattcagcctaatgtaaaccctggttcagaaagcaatacactaaatatcaaagaattataatatctagtgaatatgtatgaacagaaaccaggacaatatgagtgagagtaaagtgttaagatcaggagatggcagaatgtaagtccagatataagaattcattgccattggagaatttacctaggaataggaatattttttaacttttactttgacgtaatttcacacttaacatgggttggaaaatggtacagagaatctccagattcccaatatgttagaatgttaatgtttttaccacattgctttatcatttaccctctctcttcctctctattcctcctttcctccctctttctttccctacacacacacatgcacattaatttttcttaactgcctgagattaagttggagacataataccatttaaccctaaatacttcagtgtatatttcctaaaatcaaagtcattctcttacacaattatagcacaattaaaacaaaatgagaatattaacattaatacaatgtttttagtaaatctattcaccttaaccagagttaatcagttgtcctaataatcaattgctcctttacactaaaagaaagtcatggatgaaaagttgcataaagttatcacattcatttagcatacttaactgaaatttaacattctggcaaggctacctagagccagtgctaatatttgcttgggatggctccgtgaaggttgatagcctactgtaacccaggtagagatacccgaactgtcttgacatagtacaaaaaagtaagtttaagggattagcattgaattacagtgcaagacgtgaaaacccatcaactgactgtacatccatgtatacaaggagcaacgaaaggcactctattaagtaatgtgctagtgatggaaacactagtatctttgagaggcttagcagtggctgctgtctgtagattggggtcaatgctctattcttccatggaactgggctgtataatatcaatgtggatgttgagattctggaatgccagaggccacatggcaacactgagcccttaaccataattaatatgatgtgcagcaaggctggaatggaaatcacaatgtcttactgcccaggaatctatgacaactgaaaacaggccatggtgttctcaggggtaagatagatgggtagtcaacttgctattcttcaattttattatgattaaaaactagctcttggttatcagaaggttgatatcagatgccacatgcaaaattgctcttcttcgtgcagtttctagatctgagtcagtccacagacccaaaatccattgattcaagttgatgttggttcacttcaagtataaacagtgagtattcctttgatgtttcccccagtgagggcttcagccattttccaagtcaactgtatgctttgtatgctgtgaaaaagggaagaatattcagacttctctagaaatatatatatacatttttttttttgagacaaggtctagctccatcacccagtctggaatgcagtggcgctatctcagctcactgcaacctctgcctcccaggatcaaatggtcctcccacctcagcctcaagtatctgggactcgagttgcacacctcgagtctgggacatagtgcacacctcaagtctgggacatagtggtgcacaccactatgcccagctaatgtttgtattttttgtagagacaaggtttcaccatgatgcccaggctggtctcaaacccccgagctcaagcaatctacccatcttagcctcccaaagtggtgggattacaggagtgagccaccgcacccagcctagaaatattatatatgagatctgaaccgacactatcacagagaatctgaaaagcattttcctttgattagtgtggaggatcatggaatccaggtaagaaatggagttttggctcaagcccatctcataaggggtcaaatggatccccacatctgcactgtggctctttctctggtctttgagtgtataattgaaatgcacattctcaaatgctggaaatcttctctcattattttcctgacctgtgaattaaggactattataataggaacaaccacgtgaaagctccccaaacctccagaaatctaaatcaggaaaaatatcacattgctagaggcactgcaaaacttagtctcaccatcaaaaatttaaaagatgtaaggctagcggacccgatcacatctttctgagtgccctctacaaaatcaggtagttcatgcctcatgagagtggactactataaacttaacaaattgaagtcctgattgaagttgctattctggttgtagtatttttatgaaagatgaaagcagttcaacaaaattgtgggcacttaatataatgctattgatttggcagaatacttttttcttgatgcacatcagcaggaaacattgaaagccattcacttttgcatgtcagagatagcagagtatataccttctcttgcctgaatgctatgttaactctttatttgacataatatcatccattaggacattgaatattttgaaattcctcagaatatcattctgatctgcttcatgttaattgaacctgttgaactagaagtgacaaatatcctagatgcctgagtaagatacatgtgtaccaaaagatgggagataaattctatatttgtcgatctgctatattgttgaaatttttagggatttgcttgtatgccaaaaaggaggtaaataaacttcataaagatccatgggtctgacatattggtgaagttttggcaggatggtcttggatgatactgtgacatttttctaaagtaaggaacaagttgttgctccttatcactctcacgaccaacagagaggaacatttatttggcctcaaaaggaaagtcacaagacagacctccaggactggagaaagaacatgccctccttggtagggaattactctgtttgcagacattttctgctttgttaatatatcctagtcccagctacacgggaggctgaggtaggagaatcacttgaacccgggaggtggaggttgcagtgagccgagatcgcaccacttgccgagatcccaccacttcccaagatcgcacctgttgccgagatcgcacctgttgccaggcactccagcctgggcaacagagcaagactctgtctcaaaatatatatataatataatataacaaaatatatgttatatatgttataaatttaagagtctgtctgaccataacaacatggattctttttcaacaaggttaatccttctgcaattgctgaatgtcccaatcctccagtagtggagacagacaatcaatctccaacatggaaccttacttgccagacacctggtagaatttcaattacatcagactcctttcaattttggaagagcagcaactcatctttatctgaattgatacatactgagatatgtgtttgccttctttgtctgcaaaacccacatcatccccacaatacaagggcttagaaaatgcctaatcttattgacattaaattgtacacaataatttactgtaccaaaaggcccattatattgcaaaggaggtgcaacaatgggctcatgaacaagagaattcctggacttaccatatcactcagaatcagcaagctgaaaagaatggtggactgggaggaggagccaagatggctgaataggaacagctccggtctacagctcccagcgtgagcgacgcagaagacgggtgatttctgcatttccatctgaggtaccaggtgcatctcactagggagtgccagacagtgggcgcaggtcagtgggtgcacacaccgtgtgtgagccgaagccgggcaaggcattgcctcacttgggaagcgcaaggggtcagggagttccctttccgagtcaaagaaaggggtgacggacgcacctggaaaatcaggtcactcccacccgaatactgcgcttttccgaccggcttaaaaaacagcgcaccacaagattatatcccgcacctggctcggagggtcctacgcccacggagtctcgctgattgctagcacagcagtctgagatcaaactgcaaggcggcagcgaggctgggggagggacgcccaccattgcccaggcttgcttaggtaaacaaagcagctgggaagctcgaactgggtggagcccaccacagctcaaggaggcctgcctgcctctgtaggctctacctctgggggcagggcacagacaaacaaaaagacagcagtaacctctgcagactgaaaagtccctgtctgacagctttgaagagagcagaggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaaagtagagcgcctctcctcctccaaaggaacgcagttcctcaccagcaacggaacaaagctggatggagaatgactttgacgagctgagagaagaaggcttcagacgatcaaattactctgagctacaggaggacattcaaaccaaaggcaaagaagttgaaaactttgaaaagaatttagaagaatgtataactagaataaccaatacagagaagtgcttaaaggagctgatggagctgaaaaccaaggctcgagaactacgtgaagaatgcagaagcctcaggagctgatgcgatcaactggaagaaagggtatcagcgatggaagatgaaatgaatgaaatgaagtgagaagggaagtttagagaaaaaagaataaaaagaaatgagcaaagcctccaagaaatatggggctatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctcttggcagaaaccctacaagccagaagagagtgggggccaatattcaacattcttaaagaaaagaattttcaacccagaatttcatatccagccaaactaagctacataagtgaaggagaaataaaatcctttacagacaagcaaatgctgagagattttgtcaccaccaggcctgccctaaaagagctcctgaaggaagcactaaatatggaaaggaacagccggtaccagccgccgcaaaatcatgccaaaatgtaaagaccatcgagactaggaagaaactgcatcaactaatgagcaaaataaccagctaatatcatcatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggaacacccagattcataaagcaagtcctgagtgacctacaaagagacttagactcccacacattaataatgggagactttaacaccccactgtcaacattagacagatccacgagacagaaagtcaacaaggatacccaggaattgaactcagctctgcaccaagcggacctaatagacatctagagaactctccacctcaaatcaacagaatatacatttttttcagcaccacaccacacctattccaaaattgaccacatacttggaagtaaagctctcctcagcaaatgtaaaagaacagagattataacaaactatctctcagaccacagtgcaatcaaactagaactcaggattaagaatctcactcaaaaccgctcaactacatggaaactgaacaacctgcttctcagtgactactgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacattacaattaaaagaactagagaagcaagagcaaacacattcaaaagctagcagaaggcaagaaataactaaaatcggagcagaactgaaggaaatagagacacaaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcaacacatacactctcccaagactaaaccaggaagaagttgaatctctgaatagaccaataacaggatctgaaattgtggcaataatcaatagcttaccaaccaaaaagagtccaggaccagatggattcacagccgaattctatcagaggtgcaaggaggaactagtaccattccttctgaaactattccaatcaatagaaaaagagggaatcctccctaactcattttatgaggccagcatcattctgataccaaagctgggcagagacacaaccaaaaaagagaattttagaccaatatccttgatgaacattgatgcaaaaatcctcaataaaatactggcaaaacgaatccagcagcacatccaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacatatttcaaaataataagagctatctatgacaaacccacagccaatatcataatgaatgggcaaaaactggagaagcattccctttgaaaacgggcacaagacagggatgccctctctcaccactcctattcaacatagtgttggaagtgctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgatgagcaacttcagcaaagtctcaggatacaaaatcaatgtacaaaaatcacaagcattcttgtacaccaacaacagacaaacagagagccaaatcatgagtgaactcccattcacaattgcttcaaagagaataaaatacctaggaatccaacttacaagggacatgaaggacctcttcaaggagaactacaaaccactgctcaaggaaataaaagaggatacaaacaaatggaagaacattccatgctcatgggtaggaagaatcaatatcgtgaaaatggccatactgcccatggtaatttacagattcaatgccatccccatcaagctaccaatgcctttcttcacagaattggaaaaaactactttaaagttcatatggaaccaaaaaagagcccgcatcgccaaggcaatcctaagccaaaagaacaaagctggaggcatcacactacctgacttcaaactatactacaaggctacagtaaccaaaacagcatggtaccagtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactgtctagccatatgtagaaagctgaaactggatcccttccttacaccttatacaaaaatcaattcaagatggattaaagacttaaacgttagacctgaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaaccggcaacctacaaaatgggagaaaattttttcaacctactcatctgacaaagggctaatatccagaatctacaatgaactcaaacaaatttacaagaaaaaaacaaacaaccccatgaaaaagtgggcaaaggacatgaacagacacttctcaaaagaagacatttatgcagccaaaaaacacatgaaaaaatgctcatcatcactggccatcacagaaatgcaaatcaaaaccacaatgagataccatctcacaccagttagaatggcaatcattaaaaagtcaggaaacaacaggtgctggagaggttgtggagaaataggaacaattttacactgttggtgggactgtaaactagttcaaccattgtggaagtcagtgtggcgattcctcagggatctagaactagaaataccatttgacccagccatcccattactgggtatatacccaaaggactctaaatcatgctgctataaagacacatgcacacgtatgtttattgcggcattattcacaatagcaaagacttggaaccaacccaaatgtccaacaatgatagactggattaagaaaatgtggcacatatataccatggaatactatgcagccataaaaaatgatgagttcatgtcctttgtagggacatggatgaaattggaaatcatcattctcagtaaactatcgcaagaacaaaaaaccaaacaccgcatattctcactcatagctgggaattgaacaatgagatcacatggacacaggaaggggaatatcacactctggggactgttgtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaagtataattaaaaaaaaattttaaggaacaatacctattctaggctccctagaaatggaaaaaaaaatttcagagaatagaaaagctttatagctttctcttggcacagattaaatacattaaaataaacaaataaaaaaaggccattaggggaagggtacatttaaaaaaaaaaaaaaagaatggtggactgatgtgttgaagtcttagttaaggtaccagctcagtcataatatcttgtgatgtagtataattaccaaaactgtagcatatatatggtgttttcccgcatagctaaaaaattgaggtccgtataaccccaatgattgtcactgcagtgacccacttgtggaatttgggcttcctcattcctgcaaacataggctatggtggatttgagatactggttttaagagtgagaggtccaggacgggcgcagtggctcatgcctgtaatcccagcactttgggaggctgaggcgggcagatcacctgagatcaggagttcaagacaagcctggccaacatggcgaaaccctgtctctactaaaaatacaaaaattagccgggtgtggtggtgtccacctgtaatcccagctactcgggcagctgaagcagaagaatcgcttgaactcaggaggtggagattgcaatgagccgagatcgtaccactgcactccagcctgggcaaaagaacaagactccgtctcaaacaaacaaacaaaggaagagtgggaggtgcacttccacctgatgacacagtaaatgcttcaatgaaccagaagcctctatcactatcttgcaactttgagctcctgatgcctgtggaataacaagcaaagaaaaattcctatatttacagaggtactcaccctcatttctgtcagcagttaaagttgctgctacatacagagatagggaggattatgtttgaaactcaggggattcactgaagcatttcttagtgcgtctattttcggtgataactgtgaacatccaatttcaccaaccatggcccaaaaagagataggcaactgaatgtttaaacccttctgggatgatcccactagacaagtaacctaaattagccaaggtgtaagctaattgtgaggaaagcataaaaatggtagttgtagccgggcgtggtggctcatgcctgtaatcccagcactttgggaggctgaggcgggcggatcacctgaggtcaagagttcaagaccagcctggccaacatggagaaaccctgtctctactgaaaatacaaaaattagccaggcatggtggcacatgaccgagactgaggcaggagaattgcttgaacctgggaggcggaggttgcggtgagccgagatcgtgccattgcattccagcctgggcaacaaaagcaaaactccgtcaaaaaaaaaaaaaaatggtggttgtagagggagatgagtaatataaactatggtgctgcaatgagaacacatggacacaggaaggggaacatcacacaccggggcctgtagcggggtggggggcaagaggagggagagcattaggacaaatacctaatgcatgtggggcttaaaacctagatgacaggttgatgggtgcagcaaaccaccatggcacatgtatacctatgtaacaaacctgcacattctgcacatgtatcccagaacttaaagtaaattttaaaaaataaaaataaaaaataaatataaatatgtaaacaatatggttctgggacacagtatagtaacaggaactttatgttggcataataatcctcattcaataagcctttttaggagagtgtaactggccaccaatttgaaggattgcttcttcatccaagaaaagaaatgaggacatgttgttctcataaaatgatggctccaaattattgtatcaaggggtagactgcgtcagcctgaatttatacccctattctgtttacacaagaggagtccttggcctgccagacccttggctgcttgctcaaaagagatgtctggctgtcaccactatcactttgtctccaaatatcaacaacgctcatggcctctcctgggctgagatccaaactccctccagcagatccttctttatgcagcttcagcacaaggtctggcttttccacttcttccagcctcaaatgaagtgccattccatacactgcaggatgtgactttccgtggattactggaaatggtgaggtgaaacaatctggaagttcaagagagttaatcagctgaaccaaggtatggtggtttcacagtgcttatctagacatatccaaggcgacggagcagccaactatgttttctcatgaagctgtagaaatctctgtaatgtgctactttatattttctatctcatcccttgccacattgccattttctgtccaaactgctctgtaattgcagccctcaataaacccttagcacaaagctttgcttcaatctctgttttctcaaaaagtcaggcaaagtcacactatgtctcttgatcatcaacaccatattacatttccataggtcacaagcctgaagattgttcctagatgcatccctctcctttctacttttatatctacctccatcacctacccagcaaagtttaagcactgaaatatgatgcacaatggcctctgcgatgcagcttctatatctcttcaaccattcctcttggggttttcctccttatgtggttatctccagctacagtgatctacttgcaggatgttatatgcctccgtctataccttttcctcatgataccaaattcacccatctctgctcacagcatcctcggtgttccctatgttcatttggttaaaaaaaaatgtagctgggtggggtagctcacacctgtaaccccagcactttgggaggccaaggcggacagatcacctgaggtcaggagttcgagaccagcctgaccaacatggtgaaacccagtctctactaaaaatacaaaattagccgggcatggtggcacatgcctgtaatcccagctagtgggggggggggggcgctgaggcaggagaattgcttgaacccaggaggcggaggttgcagtgagctgagatcgcaacattgcactccagccttggcaacaagagcgggagtccatctcaaaaaaattaaaaaatgctacacatcactcaaaatggagctcatgggtcatatcctctatgaagctgtacctaacactcctgctaaatatataaaataaaaaaatacagctaacacttatacagtagtccttactctgtgccatgtactgtcctgagggctttgcatggaatgtgcttacttagttgttaccacaaccccataaatttggtaccattactatctgcatttcacagataaggaagctgaggtgcagaggatttagaacacataggtattctggtgcagatgctcctggactttcttaccattgtaagttgaaaatatcagaaatcaaaatgcattgaatacatctaacctaccgaactccatagcatgcccagaacattgacattaatgtaacattgggaaaaatcatctaacatgaagcctgttttataataaaatgttaaatatctcatataggggtatgagttgtgtaccctcatgatcacattgctgcctgagagccgcagcttgctgctctgcgcagcagggcaagaatctggtaccgcatatcactagcctgggcaaaggtcaaaattcaaaatacggtttccgctaaatccactaagtacgtatcacttttgcatcaccataaagtcaaaaaatcttaagtgaaatcatcgtaaatagaggactatctctatttaaatgaacatctatgctcttcttaatcaccctctcttgcctctccattacactagtcagcctggccgctcatgctgccgtctctatggtcttccatcagagcactaaccatgtttgcatctcttctttgttcatatgtatgcctcttcagtagactgagttgctagagttgaatatgttgatatcattactgtgtgcctagcacagagcacaggatctagtgcagagaaggtatctgataaatgttggataaataaatgttaattaatctggtacaatcttgagaatgacagaacttagacctaagtttgtcattttacaaaacactctcccaagagttatcttcttttgtcctttctatattttggtaagacatttattcttagcaaggattgaataaaaatatttgtacacaaatccctatgctttacctaagtgtatgtattggctcctctggtggtctctctgtgacattaagagacacattggaaacaattacaaattttctcaatcttctgtcccacaagctaggtaaaacacctatatctgtggaattctttagacagataatcaggcttaggcagaattttataggcccaaaattatgttttatcagagtagatacattgcaacagaaaataagattaaacacgccatctaatgtaaagaaaaattatgagttgtactggctaatatatacaaatgtactgggtctccaatagttaaagagaatagtactaagcattgcaaaagtccttacttttaacgttaaagatccttcacctccctcggtaaccctagagcagaagcttttgaaattaccctttgtaatcctcttagcaggatttactaacatttaaatctattacctatatcctttagttgaactgtttaagctcactgaaagtgttattatttttcactcaggcaacttaatggaatgggccagaattaaaatcatcgtcacaacttgaaaatgtgaatgtcacatcctgaaaattaccatctttcatataaacgaacagtcatgcaaacgttgactaaacttctaatatgtactaggcactgtgcctatccagatggaaacaaaataaactccatgtgcatgaggatgctctttaactcaccattgtttacacataaattagcactatgcttggcaagttggagacactcaaaaatactgacagaatatataagtaaaatatgacaaatgcattgtccctgcccttgaaaatattgcagtatacaatatttgagacacacgagaacctatcttgagcccatgggcaagctcatgctccacagttgtgcatgagcatgtgtggagctgcaagtccacctcaggaaagctaattagtataatgggatgtggagagcatgcggtcatgatggaacatgttaagggacacgttctttttaagggttttttttgttttgttttgttttgtttttgacggagtctcactcattcgcccaggctggagtgcaatggtgcgatctcggctcactgcaacctctgcctccagggttcaagtgattctcctgcctcagcctcccagtagctgggattacaggcaccctccaccacacccagctaatttttttgaatttgtagtagagactgggtttcaccatgttggccaggtgggccttgaacccctgacctcaaaagattcacccgcctcggcctcacaaagtgcagggattacaggcatgagccaccgtgcccagcccgggatttcatttctttagtttgtcccttttgagaaaaaaaatcaggttgtgggatgtggaagctgctcatttgtgaagagttcagatcttgcatcttgtagtttgagtcattctgtgaactctgtcactcagagggagatcctagcacagggccatgacatagtaggtgctttgtatgtatagtggagtgaggaaaattgagttaaatgaaatagctgccctcaaactcaggagtcaaagaggaaacgtccaggcaagctctctatcaccatcttgtggtctctaccagcatcttatgcttgtacagtacacccaaccccacattacagaggggaaaagaggtttggtaatagtgtgggggcagaaaaggtcagaaatgttctctaagggcaggactggctcccactttggtgaatctacccaagatttggtgggtacactgacccacaagcaagggccttaggagtccattctctgtttacaaaggcacatctctgggatggaggtaggctgaaaaagtgacttattctgagatatctaggtcatcccaggactagaagaacacagtccaggaaagttcctggcatgtcttcccaatggcaaagctaagcaactggggtgaaggtgagaaattgagtgccacatcacaactgtgtgaaaacaaaaggaggctcctgatctgaaaacggcaagattaggagaacatgtggtcctggtcctgaaacaaaagggacatattgtataaagacttgttatctcaatcctggaatgttacatttgccccacctattcatacacctcaaaaagacagggatgatatattacattttgtttatccatttatcagccataaaaaggaaggaagaaaaaatattgatacatgcgattacataagtggaccttgaaaacatcatgctaagtggaagaacttagaaacaaactgctacgtactgtatgattccatttaagtgaaatacacagaataggtaaattcataaacacagaaaatagtggttgtcaggggctgggagtaggagtcgggaatgagcaataactgtttgatgggtatgaagttttcttttgaggtgatgaaaatgttctggaatgagataatggtgattgttgcaaagctttgtgaatatactaaaaaaaacactaaattgtgcagtctaaaagggtgaacattatcatatgtgatttagatgtcaatttttggaaaagataaaaaagaaaatgtaagacagatacaggaaggaaattccggagcaacatgaatattgtgcacaattctctgtggcaggtgagccattgggaaaccatggagcctgtcactagtcattatcaagtagtatcatatacttgagtgggcacaagatttcctagggaaagcttagctagtgtcacctgggcagcattttctgcgtggtatctgattctgtgctcccaggatcaaagatttatgccagaggggaaagtttttgaccatgaattgagggattagcttctactgtcccagttccaggagaacactacaactccagaaatatactgttaaggcctatctcaaccagtgcatagtaataaaatcaacactaagactttgtagaaaactcagaccaaaaagcagttaccaactgccagacatagttgatgacaccagagatacagtccatagtcaaaacctaggagctcaagatgggaaatgccaagaaaaacagataatgattgaggccttactctgcaggccaagatgacaaattagaatagctaacatacattgggtgcttggttatgtgccaggcattgtcataagtgttttagagatattcatttatttcagcctcacaataacctcatgacataggtacgctatgacaatcctcattgagtacgtaaggaaacctgagcagagagaggttaactaactagctcaaagtcaaaccgctactaagatgtgacaccagtcctcagctaagcctacagtactgttagttgttggcatcaattatgctgaggtcaaaagagcagctgaacccccagtcccctaccacgtggggagggaggcagtaggtacaagaaacacggggacagccaaagacagcgacatccccagcgcctatgctatccatgttattagtggaaatgctcagtcacactgtgcgatctggaaagggagaggactgtaaagggaggagtatcccaggtggcagcagaaagtagtttccagccttcattccttctcacattcctgtgagagatatgggggcgctggttggtcctgggccctaatttcacccattgaacaggaaaaacagccctgaagaggtgacgggtgctgccaagacctctttcgccatctcgtggccactgggacgtatgacacccgacgcagaacctgccaggggggaaactcccaggtgggaggctgagagatgtggggagcaggggctcctaacccggggcttggtaggggaggggaggggaggggaggttctgagaaagcaaaactcctagaatcctctgtatcagcaattctagtgcattttcccgcagctgccataagatccgcagtgggttttggaacacacacaatgtaagggccacagctggagggttgggaagtggtggcaagagaagcctgctcctgttgcgggtggctctggctgagggaactccacccacgagaacttcttggtggagtttaggccgtcttggcatggagaggacaggggcggccccttccctgagagaatcctgttgagccccttaccttttgttggccatcagggcctggcctggggcccccggagtcctccttctgcccagtagcctgggttccctctgagaccaggcccagcccatcatgctctcctttctgccctctggagtaaggccccggtagcctgcctgctcccctctccatagctgccacctcctactccaccctgtgggttcagctgtccctcaggaacatggctgcgaagggggccacagccagcccagctcctcccttgcctgggacccagatggccggccctgacccttcctgatcataaaggcttcactgcgctcctgctctggcagggaggcattcagggcacacacagccgactgacacattcaggggccacaaacagcaaagacactttcagagggttcacagtcaccaccactggcctacaggttcctcccgccttttgactcagagatgccatgtgtaatctctctatatttcagaatagcagccccctcactttgttcctgaccccaatccatcctactatgcactgcttatctgaagcaatatgtattccttctcggcacaacccttatcctcacacttgcttccacctctccttccacccctaacttgacctctatccctgattccaacctaatcccttaccctatgtaaaatcggtgcttcctattatcaaggaaatgaaaaacagacatcttcaaccctcacaaaattcccaatccatcccgtccctaactatgatcctaacactcagaataattgcaaaaatcctgcattgtggacacacctgaccttcactaaccccatctctgactctcacttgatccctgactgctaccaagacccctttcacctatagatcactctttttctacattcacgtgattgccaaagcacacatccctggtttcatcctgtcattggtcctgaccatctttaactgtcagcaactagtagacacacacctaatcctttatcctttttaatgccaatgattatgtgcttatcaagtaacataagtaatattcccaaactttaatccgtccctaaccatcatcctatttaaaattattctttttattaagttatggggacacaactttgttccataaatggaaacaagaaaaaaatcatcattttaggagaatgagatgagagttgaggttgtttgtttgtttttgagatggagtttcactctgtcgcccaggctggagtgcaatggcgtgatctaggctcactgcgacctccgcctcccctcccaggttcaagcaattctcctgcctcagcctccccagtaggtgggattataggcacccaccaccacgcccggctaatttttatatttttagtagaggtagggtttctccatgttggccaggctggtctgaaactcctgacctcaggtgatccgccagcctgggcctctcaaagtgctggaattacaggcatgagccaccatgcccggccgagagtagaaattttaatgaatgagagagacagagagagtatgtgtaggggagttcccgctttcttcctctctcctcctttctctaccgcccaactcatcctcaccttctctgcgaattctaactgtcctttgtcatttagcaccctcatcttccaaagtctggctgcagaggaggtacaatagccactccccactcccgcccccctttgagaccccagatggccagcacctagaaagttcttattttgagaatgtgactattgaccctgcaggacaacattctgagcataaaagcactatcagatgcagaaaaaagggtttaaaagaacctaacagaggtcgcaaaaccaacatcttgggtcataggttccgtagtttccaacttcattttgatggcaggatagtcctgacccaaaatcccagtggtctctcgcatgctcctctatttcccctcctctcaccttgctgtcttttaagaaatcaagactggaagatacacagtagtgagaagatgtccaggaggtgcccccttgattctgtggtctgggaggtcctccagaaagggtgaaccttcatgcccacccacgcaccccggctccaaccccatttcctaggcctctgcctttcactgaggaatgatttccactggtttcctgtaaggccatgtcgcagatacggttagaacttgtgtctggatctcattctactctgcttctggggcctggcctgacatgaaatgctaatctggtccggcttatgtttatgtcagtgaagccatcctcatgaagaggacgtgcacattagaccacagtggggtttctagaacatgtcctgtccctacataggagaaactatgggtcaaggtatctttggtcctagatgcagagaatagcagactctttctgtaaaaggcctgatggtgaatgatttaagctatgcaagccacaggtggcctcggtcacatagcctccattttttcaagcaaagctttaaaaatgtaaaaatcactcttagctttcaggccttacaaatacaagtcactggccacatctgttctgtgagttagcttgccaacccctggctagacattcattctcacctctcaaatccatcaaagccctccctcctctcctgggctttccatagcacaagtgcaggtttataatgaatttcctcaccatgagtacctgaaaagagactatggaattgagttttgtgtacactgtgagggagaagtaaagtttcatttgcacgcacggatgcccagtaatcccaagaccactcattgaaaactcagtcattcccccacagaattgaaatgctgcagctatcatatatcacatgttttattttaaaagctatggctttctcatcagtgactatggaggctacaggacagtgtcacgtcctcttgaaagtgctgatgggaaaaaaaatcaacccagagttctccatccttgaaaatatcttcacagatgaaggtgaaataaatgttttcagacaaaagacaactaagattctttgtcactggtaggcatacaataaaataaatgctataggacattcttcaggttgaagaaaactacatcaggggaaaatacagatcttccagagccagaacatgttccagagtaaagaacatcagaaatgttcagtgtctgagaatgtacaaaataaattttcacttagttcctttaaaatatacttgaacgcttaaagcaaaagttctaacatcattttgctgtgtttataatgtatgtacataaattacaaatgacaataatagtataaaggacactaaggaatagtaaaagtatgtatattgttataaagattttacattctgtatgaggtggtagaatataaactctaagtacattataaaaagttaaggacacatttcaccatgttggccaggatggtctcgatctcctgaccttgtgatatgcccaccttggccgcccaaattcctgggattacaggggtgagccaccgggtctggccagcttccctactttatgaggttttgggactcggaatggcttcctggctcctcagcttgcagatggcctattgtggcacttcaccttgtgaccgtgtgagccaattctcttaataaactccccttcatatattcatctatcctgttagttctgtcccactaaagaaccctgactaatagatatgccacattttgtttattcacacacctggcaatggaaatttggatttttttccagatcgaggctgcaataaataatgctactacaaatatttgtgtatgtctttgtgcagacatatattttcatttcccttggatagtgtcacatttagaatgtgtcccccaaaattcatatgttgaaacgtaatcaatagtatgatagtattgagaggtggggcctttaggaaataattaagtcacaaaagaagagccccagggacagaattagggcctttatgaaatgatttgagggaatgggttcatcccttcctgttgcttccaccatgtgaggacacagcatttatcccttccagaagatgcagcaacaaggcaacagcttggaaggtgagagactggaccctcgcctgataccaaacctgccagtatcttgatctggaactttccagcctccaaaactgtgagaaataaatttctattgcttataaattacccagtctgtggtattttgttatagaagcgtgagtggcttaggacaggtaaataccttaaagaagactagctgggtcatatcttgagtttatgttttctttttaaagaaattgctcatgcctgtaatcccagcactttgggacgccaaggcaggcagatcacttgaggtcaggagttcgagaccagcctggccaacatggcaaaaccccgtctctactaaaaatacaaaaactagccagtcatggtggcgggcgcctgtagtcccagctacgtgggaggctgagacaggagaattggaaggctgagacaggagaatcgctcaaacctgggagatagagttgcagtgagccaagatcatgccattgcactccagcctgggcaacagagcagtactgtctcaagaaagaaaaagaaagaaagaaaggaaggaaggaaggaaggaaggaaggaaggaaggaaggaaggaaggaaggaaggaaggaaggaaggaaggagagagagagagagagagagagagagggaggaagagacagagagagagagagagagggagagggagagagagagagagagagaaagaaagagagaaagaaagaaagaaaaatagtcaagcttttttccaaaatggtgaaaaaattttacattctcactggcatgtctgaaatttccagtgtctctacaccgtcaaaaatgtgaaattgtctggttttcttattatagccattgtaatgagtgtagttttattaccttatggtttcaatttgcatttttttaatggccaatgatgtttgggcatattttcatgtatttttatacatgcatgtatcttctttagtaaagtatctattaaatatttggctcattgttatgaactgaatgcctcctaaatttgaatcttgtagcctaattcccaatatgatgatatttggaggtgagcctctgggagttagttcatgagggtagagccctcaggaatgggattggtgtctgagacgagacatgacaaagattatctctctcttagccatgtgagaatatagtaagatggaaactgtctctaagtcaggaaacaggccctcaccagacaccagttttgctgtcaccttgatcttagacttctcagcctccagaacggtgaggaatgaatgcatgttgtttaagccacccagtctatggtatttttgttacagcaaatctacctattttaatttttttaattattattgagttttgaaagttctttatagaagaacttgcatacaagtcctctaacaaatatgttttagaaatatttgtataagccatggcttacattttcattctattaacagtgtcttttgaaaagcagaattttataattttaactatgtccaatccaatttgtcaatcttttgtttatggattagcctaatccaaaaacaaagattttcccccatttccttctagaagttttctagtttttgctcatatactagggtctgtgtggccaggtgtggtgactcacacctgtaatcccagcgctttgggacgcctaggcgggtggatcacctgaggtcaggagttcgagaccagcctggccaaaatggtgaaacctcgtctctactaataatacaaaaattagctgggcgtggtggcacatgcttgtaatcccagctacttgggaggctgaggcaggagaatcacttaaacccgggaggcagaggttgcagtgagctgagatcacaccactgcactccagcctgggtgacagagcgagactgtctcaaaaaaaaaaaaaaaaagttaaggtctgtgatccgttctgaggtaacctttatgtgtgattatgtgaggtaacggtttaagttcacttgttgcatacggatagccaaatgttccagcaccaatccctgagatcctcttttttcttaatgatttgtgctaatatctttgccaaaaatcaaatgaatacagatgcaaggatttatttctgtactctccattctgttccatttatgtatatgcctatacttttgccaattctctactgtcctgattactatggtcttatggtaagttttgcaatcagttagcatatctttcaactttgtacttttgcaaaaattgttttggctattctaggttatttgcatttccatataaatttgaaaatcatcctatcaatttctattggaattttgatggggattgatttgaatttataaataaatttaggtacaattgccatcttgacaataatgagcatttcgatttataaacatagaatgtgtctctgttcattgccttctttggcttccatcaacagtgttctctcaactatagttcatggacaagtcttgtgcttcttttgtcaattttttttttattttgagacagagtctcactctgtctcccaggctagagtgcagtggcatgatcttggctcactgaaacctctgctgcactggttcaagctattctcctgcctcagcctccccagtagctgggattacaggcacctgccactgcacccggctcttttgtcaattttaaccctaagtatttttttcttgttgatgctgtggtgaatggcattgtatttttaattcaattttctgattaattgctagtatatagaaatatcaattttgtatattgatattgtgtgatgtaaatttataaaactcaattactagttctagtagttttcatgcattccttgatgttttctagaaaaaaaaaaggcagttttaatacttcctttctaatccagatgcatttaatgtctctttttgaacttgattgcactggctaaaaaatccagtaaaacgttaaaagagaagtggcaaaagtgaacatctgtgccttgttagtaatcttaggagggaggaaacaatacatttcttcaacattacatatgatgttagccctgggtttctcatggatgccctttatcaatttgaggaagtcttctgctcctagtttgttgaggctatttatcataaatgtgtgttccatttttataaatacttttatgcatctactgagaaaattatgtgattttaatcctatgttctactaacattgtgcagtacttagttgacttttgaatattaaaccaacctggttttcatgggattaatcccacttggtcatgacatataatcctatttatatgttgttggattaagtttactaatattttaagtgttatatccatgaccatgaaggatataaagggtctatagtcttctgttattctgatgtctttttctggttttggtgtcagaataatactggcttcacaggatgaatcagaagtgttttctcagcctctatttctgaaacagttgtgaagcactggcattatttcttttaaaaatatttaatagaattcaccagcgaagccaactgggttgggatttttcttagtgtaagtatttttgattattaatatatttacttctgtcgtaggtctagtcagattttttacggttttttgtttgtttgtttgtttgtttgttttttctgagatggcgccctgctcttgtcgcccaggctggagtgcaatggcacggtttcggctcactgcaacctctgcctcctgggtttaagtgattctcttgcttcagcctcccgagtagctgggattacaggcacctgccaccacacctggcaaatttttttttttctttttttgtatttttagtagagatggggtttcagcatgttggccaggctggtctccaactcccaacctcaggtgatccgcccaccttggcctcccaaagtgctggaattacaggtgtgagccactgcacccagccagatttttaatttattcttaaataagttttaataatttgtgtcctttgagaaatctgaccacgtcatctaagttgtgtaattttctgtcatgttcataatattcccttacaatccttttaatttatgtgggatcagtagtatcccaatgtcccattttcatcactgattttgataatttgtgcctgttctcttttttaaatttcttttaaagagattgcggaggggggtctcaccctgttgctcagactggaatgcagtgaggtgattgtagctcactaaagtctcagactcctgggcccaagtaattctttgcctcagcctaccacatagctgggactacaggcacgtgccaccatgcctggctaatttttaaattttttgtagagacagggtcttcatttgttacccaggctggtctcgaactcctggcttcaagtgatcctgctgccttagcctccaaaagtgtgttttttcccttggacttttaaataaatatttttttggcagggcgtgatggctcgcacctgtaatcccagcactttgggaggccaaggggggcagatctcttgaggtcaggagtttgagaccagcctggccaacacggtgaaaccccgtctctactaaaaatccaaaaattagccaggtgtggtggcacgcactggtagtcccagctattcaggaggctgaggcaggagaatctcttgaacccgggaggtggaggttgcagttagctgagatcatgccattgtactccagcctgggtgacagagcgagactccatctcaaaataaataaataaatatttttcaatttttgtatttttttcatagaatgaattttgatgttattgactttcttctcttgttttactgttttctatttctttcatttctattctagtcttactgatttactttcttctgcttgttttggacctagtttgcttttctttttctagcttctaaaagggcaaatgaggtttgaaatcattcttttctgatatagagtttaaacctataaatatctttgttattgacttagctgcagtcaataaattttgatatgttgttttaaatttcattctactaaaaatatctcctaatttactttatgatttcttccttgacccatcccatttgttattcagaactatgatgtataattccgtggaatttatggatatccagattttattcttttattattttctaatttacttccattcatactttgtaagacaggaatctttaaatttcctgaggcttgttttatggtccatcacatgttctgtcataatgatccatgtgtacatgaaaagcgggtgtataccacaggcttgtgtgaagtgattttatacatcagttaggtgaagctagttgatgttgtcttttcaagtgttatatatttttgctggttttctgtccacttgctctaccagttattgagaatgaggaataaaaatgccccccgtccctttttttttttttttttccggatggagtctcgctctgttgcccaggctggagtgcaatggcacaaacttggctcactacaacctccacctcctgggttcaagtgattctcctgcctcagcctcctgagtagcttggattacaggtgcctgccaccatgcctagctaatttttgaatttttagtggagatggggtttcaccatgttggccaggctggtcctgaactcctgacctcaggtgatccacccgtctctgcctcccaaaatgttaagattacaggtgtgagccactgcacccagcaaaatgccccattattattgctgaattgtgtggtccttcttttatttatggcacttcttgctttatgtattttgaagctttgttgcaagcatgtatacatttataattgatctagcttctggatatattaactctgacactattatgtaatttttatctgtgtattccataatattcttatcatgaagccttgccataaatctatttcttcagatattaatgtagccactccagctttcttatgattaccattgacaccatatatcttttttccatccttttactttcaacctatttgggtgttgatttaagactcatctcctgtaggtagtataaactcagatcttgcttttttatccacctaatgatctccatcttttaattttggtgtttaaattactaaaatttaatgtagtttttgatatagttgaatctaaatttgccatttgggtatttggtttctatatatctcccgtctggatttgttcctctgttccagattgactgcattcttttgtgttcagtaaatatttttaacttttcactatatattcactaaatatttttatgtaccactttaacttctctttgaatttttaattatgcttttgatttattttaatagttgttctaagggttacaatatacattttaacctatcagaatatacatcagcttaatactaacttacttcaagtaaaacatagaaactttgctcatatttatttccaaacccctccaacattggtctgttatcatataaattacagttatatattttaaaaccaacagtacaatgtaataattattacttcacataatcttaggtcatttagataatatagaaaaaatgaaaaaacaatacatagagtcttttttatattaacccagctatttaccatttcctgtgcccttcatttattcttgtggattcaagtcaccatatagagtcatttccttttagactgaaggactgtttttagttatttcttgtaatacaagtttgctagtaaggaattttatcagtctttatttcaccttggcagaatgtccctatagatggacctaggaaagagaaatacggaagcagccacaggccagaccaaaacagggtttgtattagtgcatttttgcattgctattaagaactacctgagactgtgtaatctataaataacttatagattgtagctaaggaagttgttacaaagatatttataggtttaaagactaaagacgtttaattgacttacacttccacagtctgtacaggaagcatggctgtggaggcctcaggaaacttacaatcatggtagaaggcaaaggggaagcaggcaggttttacatggccagagaaggaggaagagagcagggggagatgctacacacttttaaacaaccagatctcacgagaactcactcactacatgagaacagcaagggggaaatccacccccatgatccaatcacttcccaccaggcccctcctccaacactgagggtcacaattgcacaagagatttcagcagtgacacaaatcaaaaccgtatcagagttcaaactttcttgcccaaagtttaacattgttgtgcacatttaatttccagagcacagaaatggttggttttgtccatttcatagttgttctttggcgagaggatttcccaacatcttcacatggtcacttgagaaacgcctttctcaaacataatctttcatgttttatgaaaaaagtcaacaaaaaagccaaactctgtaaaatattgaaaaatgtttattctgcacaaaatacgactgaccatggcgcaaggcacagtctcaagacgtcctgaccaaggtggttgggttacagctttcttttctatgttttagagagacagaagacatcaatcaatacatgtgaggtatacattggtttggtgcagaagggtaggacaacttaaagcaggggaaagtgggtgcttacaggtcataggaagatgccaaggttttctgtttggcaattgcttggaggagttaagttattttctaaagacctggaatcaatagaaaggagtgtctgggttaacataaggggttgtggagaccaaggtttttattacatagatgaagtctcataagtggctgcccttagagataataaatggtgaatgtttcctatgtagactttaaaaggtgctagaatctcagttaatctcttcaggtttaggagggcctggaaggggaaagatctagttatgttaaggagatgctttacagatgcaaaatttccccaactgccttgcagggccatttcaaaatatgtcaaagaaatctattttgggggtaaaatatttttatttccttttttatcatgtgaagttatacctgagtcaggttgaaatttggtatcttattgctacaaagaatctgttttgtcagttttaagatctgttttaatgtcaattgtcatggcctgaactagttttcaggattctttagaatccccttggcagatgaatggaggggaattcagttgattgggggagttagaatttgatttttctggtcaggattgagcagaggaggccaagcgtggtggctcacacctgtaatcccagcactttgggaggccaaggcaggcagatcacctgaagtcaggagttcgagactagcctggccaacattgcgaaaccccatctctactaaaaatactaaaattaggccaggcacagtggctcacgcctataatcccatcactttgggaggccgaggcaggtggatcacgaggtcaggagttcgagactagcctgactaacatggcgaaaccccatctctacaaaaaaatacaaaaattagctgggcctggtggtgcatgcctataatcccagctactcaggaggctgaggcaggagaatcacttgaacccgggaaatggaggttgcagtgaaccgagattgtgccactgcactccagcctgaatgacagagtgagactctgtctcaaaaaaaaaaaaaaaaaattagccaggtgtggtggtgcacgcctgtaataccagccatttgggaggctgaagcaagagaatcacttgaacccaggaagcaaaggttgcagtcagcctagaacgcaccactgcactccagcttgggcaacagagcaagacttcgtcaaaaaaaaaaaaaaaatttcccagaggcaacatcaatggccaaactatcattttgttgcataccattgctggggtggtgtggctatgtgccctgggtctatcctatcccttggtggggactcacggccaacagatgtagagccaaaagacttatagccaatttaaatatcctaggccagatgggaatggaagtggagcaggcatttatcaaaccttaaaattttgtaatgtaagcatcaagaaccaaaagtcaaaaggcaaggttacaaaattgacttagctataaattctacgcattaagctagaatatcctcacttggccacttgagaagtgtctttctcaaacattttacattttatgaaaaagccaacaagaaaaacccaactctgtaaaatatttttaaaattttattctcagccaaatatgagtgaccatggcccaaggcacagtctccagaggtcctgagaacatgtgtccaaggtgattggtttacaacttggttttatatattttagggagacctaagacatcagtcaatacatgttttagttatagacttgtagcaattagcttgcaaaagataagtactttgttaaaactttttaagctacagaatttagagacttttgttgtgtcacaacgcttttagcagtctttttaatagtttgtcctaaggtgcttgatttaaaaaaactttatataacaatctgcataaatctcataactgggagcactatacccaggaggttttcttaccagaaaagttcatatcctctttgcaattttcttttaattctacaggaaagaggaaattatggttgggatggatgaaaaaggaccacatactggtccaggaggtaaagtatcttattttgccaactgtttgggcatctgtgtgcccattttttatttggaagatctaaattaattttgttgctcaaaaatcaacctttacaatcttacacatttacctcttccaagatagtgcctgagcctagagggaagatgcttatatagttttagcagtggagcattagcattgaaaatagatcgggcccagtgggattctgaatagttttaaatttcagagatattaagcagagagagagtgaaaaagtaacctttgttgttttatccaattttgcaagctatgtatagagttagtaatgtttaaacgaaagggacttaagccctgcctagctctgacaatggcaggaaaagaaaactcacaggtaactaaacatttatctagtaaggcatagaacaaattatattaagatagatagatgaaacattattcaatgattacttatgcctttgtatataggcctggtccagtgtcacatgaaagcagttcattttgactgtcatcttctcccaggtctgaagatggaactttggtcaacttgaatttgatgccagatatcaatattgactattaagattcagtaggcgtcaggattccctttcagatgagatacatgtacccaggagtcaaagccctgcaacttaacagcacaagggttagttaataacatttcataaagaccttttttaagtggggctagagggagtctctcaactgatgtctaatcatcaggctggtggtggtgatactggagtttatgacttgttggcagctgtggaaagattctatatccttatagtgattaatttttatagttttaataagcctccagcaataagtcaagtcagagacttaatttgggatttgattttgaggatatttgtcaaaaatgttaaaagtctcaaaatattttattaaaacagaaccatacaacattataaaataatagttaatcatttaacaagagtcacaatcaaaagacttcaacaacaatataggaagttacacaaatataaaaacattaaccctttcaaagtttgttttttaagtattttttaaaacctaattaaaacaacacaggaattattttgataaaatgtaaaatcactgttccttacgctaatcaccaaaaaagtaaaacaacaacaacaaaaaagacctatggtagcaattatttttccttatgggaagcttatttgaataacctgaaagtcaaacctgcatcccaggacttctcaaagacagaaaggctaaaaacagcagagtacagcagaatttgaacttctaagataatctcagaaatttcaagtttaaaaaagaattacataattaaaatttaaaaatttcttgcaatttcattgaataaatcaatattttaagaaaatctagtctaccaaaactttagttttatattagtgtatttttagtatcaaagcacaatttctagaagatgattaaataatttcctttccagtatagccaacttaatcacacacaaaatttcttttataaattctgttttttacaaaccctattatgactttcacatactatttatgacatgcttgaactttctgttttattctaggacaaaaatttatcatacaagattctttttcacacaaaattattttccttttaaactctattaccaaaaaatactgcttttatagctatagctttctttacatttcttttacttactatcagctcattttaccctgtttcaaagtaacccttgaattagacaaaaattatttacttttattaagaacacatttttatgtcttataatttttcttattttcatcagaatatatctttttttggcatgttttacatgtagaattatatattaaattcaatttttatttttagtaaccttacttttttgtgaagacctagtaaataggaaatcttaaattgtttatcacatgagcattttatagatgaaaaccattttataattaatttgtttgaaaatgtttttgtatatataatcttttaaaacaattggatatgacccacatatttaataattatctcttatttaacttaacataactttaagaatttaaaattacaggacaagtttatttataaacatttattccattgcatttatttgactatttatttatttttaatattttacctagagtacttatgaaaactgtgatgttagacaaagctagtcattatttaaagttatttctctgttaaccaattttacagcatgtgaatatcaggtgtttaactaagtatgaaatttacagttaaataaatgtttttttttttttgctgataactcaggatttatctgttttcattagaccaacaatattaaatgccttatttatcaaaaattacacaaagatcatagatttggggctgagtttatacttctatatcctttgtgccaaactttaacaccttataaaatatctataagagataaacacaaaaccacctgaccagtaaatctagacaaaatgtgtgctgacaattctgaagacatttctaattttattttaccaataattttaaagtcagcttatttgttaaagatttacttaagtcacatgaactagaaaagcactgggcttatttacttaatttatgagtactcctttattgtaaagccaatttggtactttgtggtcacaacacattaaaaaaaatggatgtacgtacatacaaacacatctaaacacatacacacacatacaaacaaagatcttatagcttttatttcagaactctaaccatgagataaatacaaactcaccagtttgaaaaaaaaaaagaaagaaaaagaaatggttggatgcagacagtggtttttatctcaactccagtagaaaagtaacaacagatttaaagcaggcagaaaagaaaatagagaaatacacataaaactttaaagactctatattcgcaggttgacttttgacctctgaatttttcttgatgtaatttagccacaagtttaaaatgtgcccaagaatagaccataatatgtaaccagctggagtattagaaaacctggcatgccttcaaacttttccatttacacaaatgcttgcaagtagaggcatcataaaaccaaacaacgtgcccaaaagggggttgttatctttgtatctcctcattctttgattatttgtttccctttttttaattttctttaagggaggaaccaaactgtagtctgcgtttcaatggagtggagctgagaagttcagtctctcgttgattcacacaagggacagttcagtttctcaagcaaatgcacaaacaagccaagtgagattaatttggggagaaagaggcaatggaaaagatccttcagaatgctttctgaatcaaaattaggatcctgaacaacaacttcctaggaaaagaaccagctcagaataaagcagaagactgtcaactgagcaggaggttcagggctgaggaggacttaccagtttcactcaagaagaagcttggagttggggggctttcaatgggcccctgctggtaccttagctctgggtttgggtgactctttcagggttctgagtcttctctgaggccccatatgtagggtgccaattaatattgactaaaaaagccaaactgtaacatatgtgaagaggtttattctaagccaaatatgagtagccatggcccaaggcatggtctcaagaggtcctgagaacatgtgctcaaggtggttgggctacagctttcttttctatgttttagagagacataagacatcaatcaatacatgtgaggtatccattggtttggtctagaagggcaggacgacttaaagcaggggaaagtgggtgcttacaggtcataggaggattccaagattttctgattggcaattgcttgaaagagttaagttattttctaaagacctggaatcaatagaaaagaatgactgggttaacataaggggttgtggagaccaaggtttttattacatagatgaagtctcataagtggctgcccttagagataatagatagcaaatgttttctatttagacttttaaaaggtgctagattctcagttaatctcttcaggtttcggaaggcctggaagaggaaagatctagttatgttaatgagatgctttacagatgcaaatgtttctcaatggctctgcaggtccatttcaaaatagggccaaaaaacatactttggggtaaaatatttttatttccatttttatcatgtgaagttatactagagtcaggttggactttggtatcttattgctacaaagaatctgttttgtcagtgttaagatctgttttttttctttgtttttgtttgtttgttttgagaagtggtctcactttgtcacccaggctgaaatgcagtggcacaatctcagctcactgcaacctctgcctcccaggctcaagcgattctcctgcctcagcctcccaagttgctaggactaaggtgtatgtcaccatgcctagctaatttttgtatttttgcagagacaggatttcaccatgttgcccaggctattcttgaactcctgacttcaagggatacgcccacctcagcctcccaaagtgttgacattataggcatgagccacctcaccaggccaagatctgttttaatgttcatgctggtcagttatgcctgaaatccaaatgggagagggtataatgaggcatgtctgaccacctacttccttccctttatggccttaactagtttttcaggtttctttggaatctctttggcagaagtgtgggatccattcagtcaactggggggttagaattgcatttttggtcatgaaacttgaccttgaaagttattttatgaatatgaaccattttcttttttttattattatactttaagttttgggatacatgtgcagaatatgcaggtttgttacataggtatacacatgccatggtggtttgtggcactcatcaacctgccgtctacattaggtatttcttctaatgctatccctcccctagtcccccaccactgacaggccccaatgtgtgatgttcccctccctgtgtccacgtgttctcattgatcaactcccacttatgagtgataacattcagtgtttggttttctgttcctgtgttagtttgctgagaatgatggtttccagcttcattcatgtccctgcaaaagacatgaactcatccttttttgtggctgcatagtattccatggtgtatatgtgccacattttctgtatccagtctatcatcaatgggcatttaggttggttccaagtctttgctattgtgaacattgccgcaataaacatatgtatacgtgtgcatgtgtctttgtagtagaatgattgatcatcctttgggtatatacccagtaatgggattactgggtcaaatggaatttctgattctagatccttaaggaatcgacacactcttccacaatggttgaactaacttacactcccaccaacaatgtaaaagctttcctatttctccacattatctccagcatctgttgtttcctgactttttaatgattgccaaatacctaatgactttttaatgatggccccaaatacctaatcctgatggtaatggtattaagaggtaaggcctatgggaggtgatttggtcatgaggctctacccccatgaatgggattagtatccttaaaaatgtggcctgagggagctcttttacttctactaccatatgaggacatagctagaaggtgccatctttgaagcagagattgagccctcattgttcaccacattttctggcaccttaatgttcgaaatccctgactccaggactctcagtaaattacgtttttaaaaactacccagtccaagttacattgttatagcaccctgaaagaatcaaggtataaattgatagcaagaagtggtgtgctgctctaacaaatacctacaaatgcggatgcagcttgggaactaggtaatgggtagaggccgtaagaatgcaaaggatcaggctagaaaaagcctacatttctgtgagcagagtgttaagagtgatctggttatggctcagaagaggagagctgtaaacaatgcctaatcttcttagagatttcctaagaggtcatgaacagaattttggtataaatctggatggtaaaggccattctgatgaagtctcaggtgaaaatgagaaatgttatcagaaactggaggaaaagccatccctcttataaagtggcaaataacctggctgaactgtgtatgtatcctagggctttgcagaaggtagaacttctgagcaatgatagtatagttagtgaaataaatatctaagcaaagtgttgagggtgtgttatggcctctcttgaatgcttgtagtaaaatacaagaagatagaaacaaattaaaaagaatttataatcaaaagggaagcagaatgtaaagatctgaaaaattttcagtgtggctatgttgtgaagagttaatgaaaaagcatattcagaagagaatactaaaggtatgaccaagccaccatttgataagaagattagtagggatagaaggaaggcagatgctattctgcatgacaataagagaatgaccctaaaggcatttcagagaccatccagcctgccactcacatcacaggctcagaataccaaacctggggcgtaaaatgaggtcaaaagagggaccttgggcatccaaggaacctcagtgcttgctgccctgaactacctcaagtctctgctccctacattctggcacagcatttttcagctccctctctcatcagatgtgtctcaaatgggcccagatgtggttcaggccaccactctaaagtgcacaggcagtaaaaatcttggcagcatcaacacagtgccatctccacaggagcacagagcaaaatgagctgtagagacatggctacctccacctatattactaagggtactcccagagagctgcagggcatggacaaagatgtcccacaggaataggactacaataaagagtcaccattggggcaatgtctattaaagccatggagggaccaccataaaggcaaagtctggtaaaaccatgagggcagggccatcccagagacctcagattggtaaagccaccagtgtgcaactccagcctaggacaaccacaaacacaagactccaacacatgagcactgtggcacgggctatgcacagaaaagtcattgggaatgggaccagttaaagccttgggggcccaatcctcatccaagtgtgtgtgaaaggcacaacactgagtcaaagaagattattctccagccttaagttttaatattgtttgtgctcttgggttttagacttccttgaaacatattaccccttttcctttcttctctctcccttatggaatgggaatttctaacttatgcctgtcccaccactgtattttggaaacataaaacttgtttaacttcaaaagctcagagtagaaggggaatttggctcagaatgaatgataccttgagtctcacccaaatctaacgtagatgatatttagatgagactttgaactttaaacttttgagttgatgcaaaaacaggttaagaatttgggggctattgacgggcacggtggctcacgcctgtaatcccaacactttgggaagccaaggtgggtggatcacgaggtcaggagttcaagaccagcctggccaacatattgaaaccccgtctatactaaaaatacaaaaattacccaggcatagtggcacacgcctgtagtcccagctactcaggaggctgaggcacgagaatcacttgagcctgggaggtggaggttgcagcgagccaagattgcaccactgcactccagcctgggtaacagagtgagactccgtctcaggaaaaaaaaaaaaaaaaaaaaaaagaatttgggggctattaggataggatgaatatattttgcatgtgggaaagacacaaatttggggggcccaagggtgggaaggtatgttctaaaagtctgtatcccccaaaatttatatgttgaaacctaacccccaaggtgatattattaagagatgtagcctttggaagctgattagataatggagggtcagtcatactgaatgggattagttccctaataaaacagacgtgagagagcttgtcacctcttctgccatgtgagcatatagatagaaggtgccatctttgaagcagagagtgagccttcaacagataatgaatgtgctggggccttgatcttggacttcccagacaccacaactgtgagcagtaagttttattatttataaaagattataaatcacctagctatggtattttgctacagcagcctgaatggactaaaataaggctgatatattttactgataatttcaaagaatctgtttaaaattcattgattattaatttttggctttctattcctgtgatttcactttcaaaatgattgaatcaattcttctcatttgcttggattaattatttgtttattaacatttggtaagattagttcattcttttcggtcttattaccttaattttcaaaactgttttatataacacttggttgagcttatgataataaataaataaataaacattttaataaagtcattaatggataaaggctttcctctgagaaaagcatctgcaggcataataggatttgacttgatgtattttgcctttaattattctctggatattatgtaagttccctttttatttcctatttgagtaaaagagaatcttaaacgtgtttattaatttcagattggataagattttggtaatgtttctttacttccaaatttattgaatagacaaatgatatggatggataaatgcttactattttaatacattaaatgattttaagccaaaagactgataaacctattaaaaattctcattcttgccgggcacagtggctcacacctgtaatcccagcactttaggaggccaaggtgggcggatcacttgaggtcaggagtttgagactagcctggccaacatggggaaaccccgtctctactaaaaaatacaaaaataggccggcgtggtggcaggcacctgtaatctcacctactcagggggctgaggcaggagaatcacttgaacctgggaggttggaggttgcggtgagccaagatcaggccactatactccagcctgggcgacagagccagaagtccatctcaaaaaaaaaaaaaaaaaaacaaaactcattctctaattgtgagatgtaaagtgttatatttaatacgtaaattgtgtttattgattgaataattcagttctttatgtcttttacaggaatttaaagactgatttatgcataaaacaagagaatcagaagtattaaatttaatcagtgcttattatggcatggtccatttatatcagtgtttttctttttgagagtatttccttattttctgaatccatgtataaataaaagctattttctactaaaaaaaaaccatggtaacatggatcaataaataatacagatcaaagcagaactaaacaaaatagagatgaaaaaccaacacaaaggatcaacaaaatgaaaaattggttctttgaaaatataaacaaaactgctgggcgcgatggctcactcctgtaatcccagcacttcgggaggccaagacgggtgaatcacttgaggtcaggagttcgagatcagcgtggccaaaatggtgaaatctcatctctactagaaataaaaaaagtagccaggcatggtggcgcacgcctgtaaactcagctactagggaggctgaggcacaagaatcgcttgaacccaggagatggaggttgcagtgagccaagatcacaccactgcactccagcctgggtgacagttttatatttatatatatatatacacacacacacacacatatgaacctgataaaccactagctagactaaccaagaaaagaacagacccaaataaacaaaatcagaaatggcaaaggagagattaccactgataccacagaaatacaaaagatcatcagagagtattatgaacgactatacactaacgaactggaaaacctagaatatgcagtctatatatacaaaatggaatactcttcagccattaaaaaaatgaaatgatgtatttgcagcaacttggatggaactgaagatcattatgttaagtgaaataagccaggcacagaaaggaaaatatagctctcattcatctgtaggagctaaaatacttgttggcatggaggtggagcgtggaatgatagataccagagacaggaaagggtgtatttgcgggagggcagtggggctgaagagagttggttaatgcgtagaaacatacagttagaaaaaataagttctaaactttgatagaagagtaaggtgactataatcaacacttttctgtagttttaaaatagctggaagaaaggacttgaaatgtacccaacacatagaaatgataaatactttgttgataggtaacttaaatatcatgaattgattattacacattgtatgcatgtaacaaaatttcacatgtacccttaaatatatacaaatataatgtatcaaaaaattaaaaatagaaaattaagaaaataaataataaattaaaaagcttaaaatatggaaagtaaaaagctgtttaatagtattgaaaagtgcttctgttgcaatcttaaatgaggtccacagcaagcatacattactttttttgtttttttaagtgtctgttatggaaggagagtatagaaatgtgttactctctgtaaggcaatttctgtaatatacaaattatgcctaactacctctattggctatgcttagaaaaggattgtggcagaccaattctccctgacaatcacacagacaggcctgcatgacagtcacacaggcaggcctgcatagcacctcagttacacagacaaatttctacagagtggccttaacattgagcaaatagtttaaccgagggaaatcgatgcccagacatcaaagctagaaataaaacatatggtcaaggccgggggcggtggctcacgcctataatcccagcgctttgggaggccaaggagggcagatcacctgaggccaggagttcgaaaccagcctgaccaatatggagaaactctaactctactagaaatacaaaattagccgggcgtggtggcgcatgcctgtaatcccagctactcgggaggctgaggcaggagaatcgcttgagtccgggaggcggatgttgcagtgagcggagatcgcgccattgcactccagcctgggcaacaacagcgaaactccgtctcaaaaaacaaaagaaaagaaagaaacatatggtcagtaggaaccttgcatgggcttctctggaacaagccaaaagaatggagacagtcttacattcctagtgccaggacccatcttgggtcaatgaaatctgagacgagtcaaggtaacagaggcagctgcattggagagtccaaggcagctctccggaccaagctgtaaaggagataagatagaaataatcattccggtaccacagtagacaggctttgaaggtactggggcccttttaattggacttagcaagcattttttttgcctctgacattctagttgaagcaaatttagttaccaatagacataggcgaatgctatattgcagtaggcacataaccccaacctatataagcactaagaaaattgtaacactttgagttggtctggtggaattatctccagcgttcttcctgtatccagttacagcaataaattcctgtgtttcctagtttgcctgcttttccgtactaggcctctagaaaatgcagcgggccgggcttcgttcctggaacaggagtaactcccaaacaagtattagtgtaggactgaaaataaatgcagactatcttgagagtctcaaaggaaaatagggtggctagagaggcctttctctaagtcttgaacttctagcattttattctctctcttaagcttggagacttcacacttatcctttcaggtagaaaatctgatactatgggaaagtactggatatagaatgttgagcagaactgcacagattgcatataatgaaagcagaactccatagacaaagtcaggtgtcaattaaatttctgaaataacaatattcctgatgagggtgagtggttttaggtctcagtttgattcacatggaaaacaaaagcggaagttgagtagtaaggcaaggttgcccccaaactggacaaaacataaggcagccatgtttgccggagttttttcagacacgaggggcgggagaagagggatctagacacggcttcttggcgtttctggagcactactgccatcgtgaggatgaagtttcatgaaaccctacgccattacactgttctcgaattctggagaacagtatttttctctctgttggggaaattctgatctgtgggaaggaggaagaggcgtggggctccaagctaggtcttcttgccttctcctctaagaccttaagatagacctggacattggcggtatcttggtgtagaacctggagagtgaggacttagaatgaaccagcccctgccgggcggtcctggcacagaaagtcgtggggcggggcctcggttcctcctctgggcaggactgcaggaacccgctcaaagacaaatgcaggctcttgtgggcatctgtctcctgttcctgccccttggagcaaaagtcagtaggttttcacatggtattatcttactacgggtctttggctctcttgtggcatcagtatccgcgcacaataaacaacgttcttccaggggaggtttacaggatttgctcttagaaccttcactctccaggttctataccaaggtaccgccaatgtccaggtctcttttaaagcctcaaacgagactaagcaaggactcccagcatggaggcgaaccctcttccaccttttaccagaccacacctgccccaacaggtagtcctcactagaactctttaatggcgtagggtttcgttaaacgatatcctcacgatggcagtagagctccagatatgccaataaacctcaccttggaggactctactcccgctcttcttgtgtgaaaaaacgccacccatagacaaaggcgccaccaaacatgggtgccttgtattttgccttctttgggtccacctggtcttactgctgcacttttgcttttgttttgtttttgcttttgtttttgtttttcttttgagacggagtctcgctctgtcgcccagggtggagtgcagtggcacgatctcagctcactgcaacctctgcctcccgggttcaagcaatcctcctgcctcagcctcccaagtaactgtgattacaggcaccgcacccaagtcgagctaatttttgtatttgtagtagagacgaggtttcaccatgttagccaggttgatcacgaactcctgacctcaggtgatccgcctgcctcggcctcccaaagtgctgtgattacagacgtgagccaccccacctggccttgcttttgtcttccgtttgaaatcaaaccaaactctaaaccatgcaccctcgtcaagaatcttattatttcagaaattaaatgtcttcttgatctagtctatatgggtatgatttacgttacagaattatatgtccagtactttccaaggcatcaaactgtctccttcaggggataaattcaatggatgagggcacaaaaaggagaaagttgctagaagcttagagattttcgctggcaaacaatttacaaatcctggtggtctctgttctggctcccctcccagacaaccagggagttcttcatgttgtagctcatgtgttgcattgtaggcaacaatgtggcatgcatgaatcatagagaagggaccagatagctgtcattactgcatgtcaaatatgttccgcatggcaagatactcatagtacatatgttcaattcctgtccaggttactcagtgtttcatctcggggtctcatcatctaacatcaaaacacagcatgttcccatgccattacatattcttcaggtatttcctgagactttatggtgtgtgtgtgtgtatgtgtgtgtgtgtgtctgtctgcattttataatttgtcttttaggtataatgtttacagtattctcccactaattaattaaaaaataatggctgccaaagattcggaaaaatccacatactactaaagaagaaaaacactaccatacaacgtgtcaaggcaactaaccttttggatcatttctgtgtatatctttcaatatatatatacattcttgatttcatgtaaaaaataaatctgtattaaaactggattataggctgggcacggtggctcacacctgtaatcccagcactttgggaggccaaggtgggcggatcacctgaggtcaggagttcgtgatcaacccggccaacacagtgaaacttcatctctactaaaaatacaaaacttagcgggcacctgtaatcccagctactcaggaggctggggcaggacaatcacttgaacctgggaggcagagggtgcagtgagccaagatcatgccactgcactccagcctgggcgacagagggaaactttgtctcaaaaacaaaacaaaacaaaacaaaaaaactggattacattgtacattgtggattgaatcagaccaagtatgtatgttaacaaaggtttgaggagcatgaattaatttgaatgtcatcaatattatatgtcaacattttaagccttcattataaacaaaggtaaatcttaaactatgccctcgaaaacattgctttagaaaagtagacactattttttgtttgaatttttacagatacatcacaatgtgcatattggctctctagaacacatacatgattatatatttggtttaaggttatcacattttagaagtagagtaaaatatactttactttgtcatttaccgtgtggaagggtttaatcctcaaggttcaataatttacttttctcactaaatcagacacagggaatggctgcttatgaggacatagaatgcaattaagattttgtgaggactaaagggattacctggtgcagatgaatgacatgtatccaacctaaatgggaatgataggctcattgcccctccacactatcctcccttgcagaagaaaccaatcaacctcctgtcactaccactgggattcagctaggtgtgatttccttaccaggcttctatccactgcctaggcacacagcctctattaaagatagttagcaaggaatgaataaacaattctttagcctaaggaattctaggtctgagaccagcaacttttctagctttgttacactaagtagctagtcaggtataagcagagcaggtgaggctctccccacccaccaggaatgtcaggcgaccatcaggtgatagtcaagcagttgtcacactgcctctctaaaataataactgggtgcaccctgcaccaagaagcagtttcccaatagataaaaacacctgaaattggtaatcagcagcttccagtaagatctcaggaattggtcaagtgggcttcacattaagaggcaaaatggtggaatttaactggtatatggccttccagggatattgcacggtaaagggaagaatgcctcacctgagcacgtgtacagcttcagtaaatacactgcgcatgcaggcagcctgccgcaatggaagaatcaaaagaaaagggacacaagatgccggaagtaggccaccatataaaatcctaggtccaaggtcaaacggagcacttgaccaagatgtctgcttggccctcttccaagtgtactttactttcttttcatttctgctctaaagcttttgaataaacatcactcctgctctaaaactttccttggtctcttcttctgccttatgcccctcagtcggattctttcttctcagaaggcaggaatcgaggttgctccagacctgtttggattcaacgctggtagcacagataacttcaaccgctaatatatttatacaaacacaacccaaagaaagccaaacaccatttcatagttgacagtgtttactgtatgattgttataccaaataggccaaatatatcatgtttggacttcagaggacttaatatctaaactagtaattatgtcagaaaaaaatataatttataatttaattttggaagctttgtcaaatatcaatggtttaaaacacttgatattataaaatcaaatcccaggtcaccatgagtcatttaattagccaaaacaataactcaaaatgttttaaaacggaaaaaacctttactcattaagagggagacttagctctccaaacaatctgtctttttttctttcccttcttcttcctacagtttattcaaaaggcaaacaaaaatctttcatcatttcttaatatcacatgaaaatcttgttcaagagagaaagccaaatttcaccattgtattagtgcactattgatgtcaaacccaaatcttaatgaaaccttatggacaaatctatccaattttaatgtctgaccataaggtaagattcttataaatcttttataattctttgccaatttttgttaaagagcaaattagtgctgtaagaaaactctgttgtactttttttttttttttttgagacggagtcttgctctgtcgcccaggctggagtgtaatggtgctatctcggctcactgcaacctccactttccaggttcaagcaattctcctgcctcagcctcctgagtagctgggattacaggcgcccgccaccacacccagctaatttttgtatttttaatagagatggggtttcaccatgttggtcaggctggtctcgaacccctgacctcgtgatccacctgcctcagcctcccaaagtgctaggattacaggtgtgagccaccatgcccagccaactctgttgtacttttattccaatgttcaatttatggaaaaattaaatagtacccctttaactttagctaatatgttcacacacagaatttcatttacaattaatttgtcacaagccttccataagtgttcaaaccttcagatttttctacctaacttaaaacattattattttagagaggcagtgtgacaactgtttgactaccgcctgatggtcagctgacattcccagtgggtcggcaagagccctctcctgccctgctcatatctgactagcgacctactataactgcttcagatatgggacactgtctcatatgtagggctgctctcttccacaaaaatggtcagaccaagctatttctccaggaggtagtttagcagtccccagcctttttagcatcagggatcggttttgtggaagataaattttgcacagtccaaggttggggatggtttcagttagattcaagctcactacattaatcatgcactttatttctattgttattacactgtaatatataatgaaataattatacaactcaccataatgtagaatcagtaggcaccctgagccttgttttcctgcaactagatgatcccatctgggggtcatgagagacagtgacagatcatcaggcattagattttcataaggatagcccaacctagatccttgcatgaacagttcacaataggattcatgctcctatgagactctaatgttgccaatgctgacaagaggtggaactcaggcggtaatgcaaacgatggggagtggctttaaatatcagtgaaactttgcctgctccacgctcacctcctgctatgcagcccagttcctaagagaccacagaacagtacaggtccgtggcccaggaactggagacccttgatctagcagatatctaagtctacgttaggtgaaacagcgtggggagtctagatgtcattttgtcatttccaggaatgggggtcattgagaaatgcttcccagagggtcgttaagacacttctatttttgttttgttttgttttgttttgagacagggtttcactttgtctcccaggaagaagtgcactgttgcccactgcaaccttgacctgcagggctcaagcaatccccccagcttagcctcctaagtagctgggattatgggcaggcactaccgtgcccagctaattttgtggggatttttatacagacagagcttcaccatgttacccaagctggtctcaaactcctgagctcaagcaatccacctgcctcagcctcccaaactgctaggattgcaggcatgagccaccgggcctggccgaatctttaaaacattcctgaatgccaatagcatctatgtctacagaccatcaatcaactctaaccagcttgagggagagctaggtacagtcaaggatgtcacaaaagccaggtcccttaccctggaatgcctgcctgaatcttcagaggccaggagaagtcctacctgaagaagatcttgaagcactggaaggtcacactacagtaccagactaatattacatccttttttaaaagattcagatactgagataacaaacaatgaaaaagaatgtcatggggaacaagtcacccatacaattttagccacccttgttgatttttcaattatgagtcatggagtatctggaggtctccacacctaagggtggatatcttcatgaagaactagctttgaagctggtacacagaacgctcgctagaatgagataaatactggtttcctcaggactaaaaaatgccatcattctcagggaatgtccaacggaaaagagccacctatctgccctccttgagagaactgagattaccatcagtgtcctagtatgagaaaagacattcccatgaacttataaagtcacagataatcctggcttgtgggcttagataattgcttaggctttccattacattcttgcttcctggaagcagctagctcagtcctggtccctcactcaccagatacttcactaagactttgcatttgtccattgattgtgccaggcctcagagaaaagggtaggaatgccaacttgtgtcttgggcctgttcagcctccactggcttttccttccgcgacggctagggtttacgtggaggaaatgctcacggcttcggatgctatgaaactacttccgcatgatggcagtattgtcccagaaaagccaagtagcgctaggcgctcctctcccgcccatcacgtttgaaaaaaatgccatgaagggacaaagacaacagaaactaaaactatctaacatttttgctcaacttgcataaatgtattccactcttggcattttgcttttggcttccattgttttttttgtttttgttttttcttttcacagacggagtttcgcacttgttgcccaggctgaagtgcagtggctcagtcttggctcacggaaacttccgccgcccgggttcaagtaactctcctgcctcagcctcccaagtagctgggattacagggacgcaccaccacgcccggctagtttttgtatttttagtagagacgggtttcaccatgttgaccaggatggtcgtgaactcctgacctcaggtgatccacccacttcggcctcccaaagttctgggattacaggtgtgagccaccgcgtctggccccatcggatattaaactgagatctaatccactcaccctcatcaagcatctcctgttttcaagaactcagtattggccagccaggattgctccagtgcactccagcctgggtgacagaataagagtcgggctcaaaaaaaagaaaagaaaaagaaagaaaaaaagaaaagaaaagaaaaagaactcagtatccgcacaaccaagtctttccctttctgctttttcactcagcatcatatctgaagggttttattgtgatatcgaattgtcttgtaatattagggacagacctcagggatccatgcctacggaaacaaacaaacaaaaaagcaacaacaaatgtttacccctaaggtcttggagaatagcaaagctaagcaccaggccatgtggttcttgtcctgaccctctgtcaggcctctgagcccaagctaagccatcatatcccctgtgacctgcacgtacacatccagatggccggttcctgccttaactgatgacattccaccacaaaagaagtgaaaatggcctgttcctgccttaactgatgacattgtcttgtgaaattccttttcttggctcatcctggctcaaaaagctcccctactgagcaccttggagcaccttgtgaccccgactctgcccgccagagaacaactcccctttgactataattttcctttatctacccaaatcctataaaacagccccacctttatctcccttccctgactctcttttcagactcagcccgcctgcgcccaggtgaaataaacagccatgttgctcacacaaagcctgtttagtggtctcttcacacggacgtgcatgaaattttgtgccatgactcggatcaggggacctcccttgggatatcaatcccttgtcctcctgctctttgctccatgaaaaagatccacttacaacctcaggtcctcagaccaactagcccaaggaacatctcaccaattttaaatcgggtaagcggcctctttttactcacttctccaacctccctcactatccctcaacctctttctcctttcaatcttggtgccacactttaatctctcccttctcttaatttcaattcctttcattttctggtagagacaaaggagacacgttttatccatggacccaaaactccagcgccggtcatggactagggaaggcagccttccattagtgtttaatcattgcagggacacctctctgattattcacccaggtttcagaggtgtcagaccactcaaggacacctgccttggtctttcacccttagcggcaagtcccgcttttctaggggaggggcaagtaccccaaccccttctctccgtgtctctaccccttctccgcctttctgggtggcaagaaacctccaaccccttctccttcactcttagcagcaagtcccacttttctgggggaggggcaagtaccccaaccttgtatctctgtgccccgatcccttctttccatgctccgacctcttatatctctgcaccccgatcccttatttctgcaccccaacctcttatatctctgtgccctgatcccttatttccatgccccgacctcatatctctgcgcctcaacccctttcccgcttttctggaggttaagaacccccgaaccacttccctacgtgtctctactctcccttttctttaaacttgcctccttcactataggcaaccttccaccctccattcctccttcttctcccttagcctgtgttcttaagaacataaaacctcttcaactcttgcctgacctaaaacctaaatgccttattttcttccacaatgccgcttgaccccaatacaaactcgacagtggttctaaatggccagaaaacggcactttcgatttctccatcctacaagatctaaataattcttgccgtaaaataggcaaacggtctgaggtgcctgacgtccaggcattcttttacacatcggtcccttcctagtctctgttcccagtgtaactagtcccaaatcttccttctttccctcccacctgttccctcagtcccaaccccaagcgtcactgagtctttctaatcttccttttctacagacccatctgacctctcccctcctcgccaggccgagctaggtcccaattcttcctctgcctccgctcttccaccctataatccttctaccacctcccctcctcacacccggtccagcttacagtttagttccgcgactagttcttccccacctgcccaacaatttcctcttaaaaaggtggctgaagctaaaagcatagtcaaagttaatgctcctttttctttatccaacctctcccaaatcagttagcgtttaggctctttcatcaaatctgaaaaacccagcccagttcatggctcgttcggcagcaaccctgagacgctttacagccctagaccctaaaaggtcaaaaggccatcttattctcaatatacgttttattacccaatccactcctgacattaaataaaactccaaaaattaaattccggccctcaaaccccacaacaggagttaattaacctcaccttcaaggtgtacaataatacaatagaggcagccaagtagcgacgtatttctgagttgcaattccttgcctccactgtgagacaaaccccagccacatctccagcacacaagaactccaaatgcccgaaccgcagctgccaggggttcctccagaacctcctcccccaggagcttgctacaagtgccggaaatctggccactgggccaaggaatgcccacagcccgggattcctcctaagccgcatcccatctgtgtgggaccccactgaaaattggactgttcaactcacttggcaaccactcccagagcccctggaactctggcccaaggctctgtgactgactccttcccagatcttctccacttagcagctgaagactgacactgcccaatcgcctcggaagcctacaggaccatcacagacgctctaggtaactctcacagtggagggtaagtctgtccccttcttaatcaatatggaggctacccactccacattatcttcttttcaagggcctgtttcccttacctccataattgttgtgggtattgatggccaggcttctaaacctcttaaaactccccaactctggtgccaacttaaacaatactcttttaagcactcctttttagttatccccacctgcccagttcccttattaggccgagacactttaactaaattatctgcttccctgactattcctaggctacagccacacctcattgctgccttttcccccagttcaaagcctccttcacatcctccccttgtatctccccaccttaacccacaagtataagacacctctactccctccttagcaaccgatcacgcaccccttaccatcccattaaaacctaatcacccttaccctgctcatcgccaatatcccatcccacagcacgttttaaaaggattaaagcctgttatcactcgcctgctacagcatgggcttctaaaacctataaactctccttacaattcccccattttacctgtccaaaaaccggacaagtcttacaggttagttcaggatctgcgccttatcaaccaaattgttttgcctatccaccccgtggtgccaaatccatatactctcctatcctcagtacctccctctacaacccattattctgttctagatctcaaacatgctttctttactgttcccctgcacccctcgtcccagcctctctttgccttcacttagactgaccctgacacccattaggctcagcaaattacctgggctgtactgctgcaaggcttcacagacagcccccattacttcagtcaagcccaaatttcatcctcatctgttacctatctcagcataattctcatgaaaacacacctgctctccctgctgatcgtatccgattaatctcccaaacctcgatcccttacaaaacaacaattcctttccttcctaggcttggttagtgcggtcagaattcttacacaagagccaggaccgcaccctgtagcctttctgtccaaacaacttgaccttactgttttagcctagccctcatgtctgcgtgctgcggctgccgctgctttaatacttttagaggccctaaaaatcacaagctatgctcaactcactctctacatttctcataacttccaaaatctattttcttcctctatctgacgcatatactttctgctccccggctccttcagctgtactcactctttgttaggtcccacaattaccattgttcctggcccggacttcaatccggcctcccacattattcctgataccacacctgacccccatgactgtatctctctgatccacctgacattcaccccatttccccatatttccttctttcctgttcctcaccctgatcacgcttgatttactgatggcagttccaccaggcctaatcaccacacaccagcaaaggcaggctatgctatagtacaagccactagcccgcctcctagaacctctcattttctttccatcgtggaaatctatcctcaaggaaataacttctcagtgttccatctgctattctactactcctcagggattattcaggccccctgccttccctacacatcaagctccaggatttgcccctgcccaggactggcaaattagctttactcaatatgcccgaggcaggaaactaaaatacctcttagtctaagtagacactttcactgaataagtaaaggcctttcctacagggtctgagaaggccaccgtagtcatttcttcccttctgtcagacataattcctcagtttggccttcccacctctatacagtccgatagcagaccggcctttattaatcaaatcagccaagcattttttcaggctcttagtattcagtgaaacctttatatcccttacagtcctcagtcttcaggaaaagtagaacagactaatgatcttttaaaaacacacctcaccaagctcagccaccaacttaaaaaggactggacaatacttttaccactttcccttctcagaagtcagacctgtcctcagaatgctacaaggtacagcccatttgagctcctgtatagacactcctttttattaggccccagtctcatccagacaccagaccaacttagactgtgcccccaaaaaacttgtcatccctactatcttctgtctagtcatactcctattcaccgttctcaactactcatacatgccctgatcttgtttacactgctgtttctccaagccatcgcagctgatatctcctggtgctatccccaaactgccactctaaactcttgaagtaaataaataatctttgctggcaggactatgctgaatctccttaggcactctctaatcagatgtcctgggtcctcccaattcttagaccttttatacctgtttttctccttctcttattccatttagtttttcaattcatacaaaaccgtatccaggccatcaccaataattctacacgacaaatgtttcttctaacaaccccacaatatcaccccttaccacaaaatcttccttcagcttaatctctcccactctaggttcccacgccgcccctaatcccgctcaaaggagccctgagaaacattgcccattgtctctccataccatcccccaaaattttcgctgtcccaagactttaccactatttcattttatttttcttattaatataagaagacaggaatgtcaggcctctgagcccaaactaagccatcatatcccctgtgacctgcacgtacacacacagatggccagttcctgccttaactgatgacattccaccacaaaagaagtgaaaatggcctgttcctgccttaactgatgacattgtcttgtgaaattccttttcctggctcatcctggctcaaaaagcttccctactgagcaccttatgatccccactctgcccgccagagaacaactcccctttgactataattttcctttatctacccaaatcctataaaacggccccacccttgtctcccttccctgactattttcggactcagcccgcctgcacccaggtgaaataaacagccatgttgctcacacaaagcctgtttggtggtctcttcacacggacgtgcatgaaactctctacccaggttccctgggagttctactctatgttctgacctagacattaggtcttacgtgttgaggggaaggccgctattgctaattagtggagctctaagataagggtccacataactcttaaacttgacagacacaacccttcttgaatgtacacaaatacaggaatgactataaatgctaatcagatggatcgcaggattttgtctcatggtttcattatttaatattggtacagaaatattttccagtgtcatgaaatggcaatggcttaagaccgtgtcctatgactttgctgtgtatgtgtcttattgtttttccgttaggattcaatcctatattttctcattagtagaaaagacgtggaatttgcaaagaagtaaaaagaaactatgtgctgatcaaaagaaaagcaatgtcataaaactgtgtattaaatactgataactttttccatattttgtcccactttcaatacatagataaaagttctacatatatgtatgcaaacactacaataaatttacatttaaattggatttagctatacgtcatgttttagagtgaacattttcacatgtgattcttgaacagtttttgacattgttataaaaaaatttgcaatatctggattttaaacaataaaatatttgcaaagaattacttgattgaacaagtcgttaagaagttcttggccaagtacagtgactcacacctgtaatcctagcactttgggaggccgagatgggcggattgcctgagctcaggagttcaagaccagcctgggcaacatggtgagacgccgtctctactaaaatacaaaaaaaaacccagccaggagtggtgcgggcgcctgtaatcccagctacgcgggaggctgaggcacaagaattgctttaacccaggaggcagaggttgcggtgagccaggactgtgccactgcactccagcctgtgcaacaaaatgaaaatctaaaaatctacctatacatacatgaacacatatataaatacatattacatataatataaatatatattatacatacttatacctcagaattagcttttaattcttctcaaatttttatccctaattcttatcttaaattttatctttaaaatctcaaaagaaatataacaaaattccataaatgatagttgagataggcatctctcacattcagtcacctagatgtgtaacctaagaaaactttaagatggaagtattcacaccactcacatgcagctacaatgtttcattaatgtgtgtcttaatataaatatgaatgatataaatttgttggccaatactatcatattcaaacatgtactcactataacactgaccatgatttaaaatatatggcattaggccaggcatgatggctcacaactgtaatcccagcactttgggaggccgaggtgggcagatcacatgaggtcaagagttcaagaccagcctggccaacgtggtgaaaccctgtctttactaaaaattcaaaaattagctgggcgtggtggcaggtgcctgtagtcccagctacttgggaggctgaggcaggagaatcgcttgatcctgggaggtggaggttgcagtgagccgagatagcaacactgcactccagcctgggcaacagagtgagactgtctcaaaaaaaataataaaaaatgaaataaaaatatatggcattggccaggtgcggtggctcacaactgtaatcccagcagtttgggagactgaggcaggtggatcacttgagcccaagagttcgagaccagcccaggcaatgtagtgagaccctggctctacaaaaaatagccaggcacggtggtgtgtatctgtagttcaagttacttggaagtctgagttgggaggattacgtcagcgcagggaggtcgatgatgcagtgagccacgatcatgccactgtactccagtctgggtgatagggtgagagcctgtctaaaaaatatatatatatgtcattttaaaactgtgtatacatacagacagatatgatgcagatacacagtcccacacacattttactttcaatataattcaatgcatactgtttgcaattttgtacaaaatctttagaacaccttataatatctgcatgaatccatatcaatatatacttttgagggcttgagatttttggattttactctagaagaactttaagaaattataattcaaaaagtatatggtaggtcaaacatagtgagacgaagtaatttaaaatgtctgggccatatattatcatctgttgacgatgcacatataatatgaacttataagccaatgttcaaattatcctgtagtgtaactattaaaacaagttatcttcacttacaaattaagtacttttcaaatataataattaattattcttggaaataataataggttttaaaatattggcactttttagaactgagttatgctaaattctttccttattgtactctactggctaaggaacaaaaaggctcacccggcctccagttatacagttcatggctattcttataaagttcatagaaggctctagagggaacgcatgtaaagcggcaccggtgcccacctaagtaacgccagagacgtctggaactctaagtttggaccccacaggaggatgctctggaagatcctccgtgcctcaaattctccaaagaggatgctttctgcagaggttctaaggtctagtattaagccctccttggaattttctctcagagttgtaatgttccttggccccaaaattgtttagaatctgaagtttattgtctaatgggaaagccggatggtgttgcatgtaaccgggcttttgtgctgctgttctaagtagggggcctcgttaacgtgtgatgccttcctttgttagtttggccccagtgatccttattggagtctggggaggtttagactttaaaaatcaaactgccatggagactgcttacccgaaattttggttcacagccttcattggattatctgttggggcaaagtaaaactggcaagcttgtattgctatctcatggctaaagttgcaagctattggagcctgcagctcccacgcaaggggaagaggaggaagtcctcccctacaaagcgaattcacaaacttgaaagaagcaatttacacaggatgtgcagatctcaacggaaggacaccggaaacatcaaaagcaaggaaacgggatacttccaaaggaacccagtaattctccagcaacagatccctatccaaaagaaattcaagaaatgtcagatagagaattgtgcatactgattttaaccaagattaggggatacaagagacttctgaaaaagaaaggagcgaaatgacagaagcaattctggatatggttgaggtaattaccaaccagatacggagttttccagggcacacagcaaatgtggaactgaagaaatcataggatgaaatacaaagtacactcaaaagcttcaatgatagactagatcaagcagaaaaaaccctcagaacttaaaatctgaaagcctttttctcaattcaaagatttaaagggttgtactctggccattcacgtgaacaaaatctgctgggttaattggtttggttttttttcctttttttgagagggagtctcactctgtcacccagactagagtgcagtggcacgatctcggctcactgctatctccacctcccaggttcaagcaattctctggcctcagcctcttgagtacctgggattacaggcacctgccaccaagcccagctaattttttgtattttcagtagagatggggtttcaccatcttggccaggctggtcttgaactcctgacctcatgatccacccgcctcagcctcccaaagtgctgggattacaggcatgagccaccgtgctcagccactgggttaattgttatagtggggtcttggataatcactaaaggtgaaataaaaattaaaaaaagtatattggtggaataaaaatagaaaagccttcagaattgttgacatacattttgtctgaattttgtttgtctttgccagatattttatttatttatttatttatttatttatttatttatttatttattgagatggcgttctctattgcccaggctgcaacgcaatggtgcgatctctgctcactgcaacctctgcctcccaggttcaagcaattctcctgtctcatcctcccaagtagctgggattacaggtgcctgctaccacgcttagttatttttgtatttttagtagagatggggtttcaccatgttggccaggctggtctggaacttgcgacctcaggtgatctgtggccttggcctcccactgtctttgctggatattttaaaatgtcagtgttaattcaagctgggggcttgggctgagcctgcctcccattccattcaaagtctcactgagataaatgcatatctgattgcttcctttggaaaaggtaatcacaaactcaaaggatgcaaccctttgtctcccacctgtgatctaaaatctcccaagccgcctcctctccagttgtcctgtcttgtttgttttacatatgttgattgatgtctcatgtctcccttattaaaaggaaaaataagtacggtgaatgaggtaaatgttttagataaatttttgtgtaaattaaaatcttaaagttatttttgatcctcatttaatatctgggtcatttccaattaagacagggttgtgatacggggaaacatgtttctaaaattgtggaattgttcttatctataaatgcctatatctgatagttcagaatttattgctgtttagggtttcactgacattttacgttactaaggataaaaattttagttaacaagtaattttgtatgcaaaatgggccagaaagggttacgttattagtggaaaaataataattttgtctaattcagaagttatctaaattttgttcaaattacagttttgaaaagattatttatgaaacaatgtagtaaggaatcattataagtagggaagaaagttgtggaaaagtttaattaataaaatattctttaaaacctgagagaattggagacatttggctaatgaacattctcatagttaaagttcttagtcttgattaaagtaaaataagaagtattatacaaatgtatcagcaacctggagcagtggctcacgcctttaatctcagccctttgggaggccaaggcgggtggattacctgaggtcgggagttcaagaccagcctgaccaacatggagaaatcccatctctaccaaaaatacaaaattagccgggcatggtggtgcatgcctgtaatcccagctactcgggaggctaaggcaggggaatcacttgcacccgggaggcagaggtttcggtgagccaagatcgtgccattgcactccagcctggccaacaagagtgaaactccgtctcaaaaaaaaaaaaaaaaaaaaaagtatcagcagtttgacaattttttttaaaatataggtaagcatgaagctggaattagtgtggagccaatttcacatatatgcttgcattgcttcacactatgttgaggtggcatctgccaccatgccaggctaattttgtatttttggtagagacggggtttctccatgttggtcaggctggtcttgaactccccacctcaggtgatccacctgccttggcctcccaaagtgtgagattacaggcgtgagccaccacgccatttgacatggatactgttggagtacatattggtcatgtgcctaaagtaaatttcttaattgtacagaatatataatgatattggtgaacttaagggtattgaattgtgtatcaggaattaatggagcacaccagctttttatccataaactaactttttggattttaggcttcctgatactctaaatgtgttgagtatactctcacaaatagaatttgagtcatatttctctctctctggctaatttctccaaatttgtaaactatgaatattcttaattcatggcaatgtgtttccttgcatacagtcaagcatggtcaccagggccactcagggagagacaatccagaaacctggcatgcagccaaaagggtaagaattttttaccagtcagtctctggcctctatctctgtgtgcaaactcgttaatctcctctgaaattttaaattactttgtttaataataaaaagaacttaaatcaaatattttgtcagaaaagtagagtgtaatgccttttagttcacataactttagcaatctttgggatataaagatggttttatagattattggtaggagaggtgtggtggctcatgcctgtaatcccatcgctttgggagcccgaggcaggcggatcacctgaggtcaggagttcgagagcagcctggccaacatggtgaaaccccgtctctactaaaaatacaaaaattagcagggtgtggtggcgggagcccgtaatcccaactactcaggaggctgagacaggagaattgcttgaacccaggaggcagaggttgtggtgagccgagattgtgccattgcactccagcctgggcaacaagagggaaactctgtctcaaaaaaaaaaaaaaaactgttggtcagatgcaaggtttgctaagtgttttaatgttacaaactgctttttgggttttgagaactgtctgtcttgcctgcttcacacttggtgacacctggggacatatgaaactaaccacacccttaactaagaaggcaaggcttgactgcacttagcatacaagtaaagcaacttaccgtgttttaccttaagggtaaaattgctaggaattaattgaaactactagaaatagatttacatgcaaggtgtgtaaaaacagtaaaatgtatttttatagtaaaaggttaaatgaaggcatggaaatgtcaagttttgcctagggttaaaggattgttttgagttaaattaggaaaaagctgaaggttcaaagaagtggtggaagaattgtggaaattagtcttgctgaagaggttctctgtgtgaacatgttgactaaattcaaaagggttataaaaggtttttgcttctttaaaatttctgagctatcattttggcaaaataaataacttgtagtaatctggaattcccaaaatcaaacttcagtttcaaaattgtcttccctggcacctgccttttggaatacttcagagggtccctgaagtgtccagaaaagagaggtaaacaggattaggtacatggtattaaatacagtgagttctaaatttttcttcaaagaatcagtatgtcagtatgttcagttctttgttccccattttaaagtttaacttcctcattctcctcgtctccttgcccctggtttcagtaaatgaccttttccatcagttctaatcagtagttcacacctgttcccctggtcacctgctccatcctgagtcacccctggttacccgctctgatctgtcacatttagtcatgtgttccgtaaccatccttcccaccaaaactgctcaccccgccattctggtcatacccctgctctctttaaaatagccaatcagaattagcttagactgtgcagtccaaccctagcctatagggcaacgacacagcagtaggggctacctgcatcagggataagaaccccttcccctcccctgttcaggtgtgctctcgccattgctccatctgtgagacgcacccttctatagaagaaaaattgccttgctgagaaaactcatgttcaagtgctatttcttttgtggcactgaaaatttatttctaacaatgggattgccaaaatgatgcttaatcttctttaggttatatttttgtgaataatactaatatatattccaaaattgtatgggatttctaaaattctaatgtctaaatatatgctaccaatcacaattatagttattatgctgttattgtaaattacagaaataaccaaatttccttgtataaagctactaacccaagtaaatcaaataattaaatataaagaaaacagtgttaaaccagctaatactaaaattgtttaaaatagtttataaccaatgcttgatcccatattcctaggaaaacaattaaagtttcaggtacatttggccacctggttggccatttaaacattttataaagggatatcattcaattgtcatttcaatgcatgttttctggttgtataaaagctttcctatgcaacagagctgatgttctaatagtagattattatgctacagtgtattttcaccaggttaaaaaaaaggctttttatggtttggatcttctgagaacatcagaaaaagactgtccttgccatccacactacaacaaaacttagggaccttgagctttgggttcatggtcttgcaactaagaagggttcctccacacttttggaactgtgcacccattgtaacccttgaggtaaagctaaccagggaaatttctcccaagaagaagatggcatccttgatgtgaatatctttcccaaggtcacagattaagacttctagtgacatgaaactcttctctttgaaagtttttttcttgcttatgtctctgtgaacaatagaagtggaaaagtgtctgttatgtgcactaatagggtgtacttttatttgtgaaggagcttccagccagcctgcaagtgtaaggttacatggataagcttatactttggtagataaaggataaaggccaatgtatgtaagaaactttaatggtacatgcattgcctcataatcagtcaaaagcagaacattggttcattcctcttggcccatttcattggttgaagagaacactgccagagggccttcactcttctcaaagggcatcatttgttaagtcctttttccatgatttggagtaaaagaagcaatgattggaaatatatccctcatgataggttctatagcaaattctactgtaaaggctgcagttgcacagtgattctaaattctcttgtgaaagttgggatagaaatggctaaacagaaaaagtatctgtgcagctgctggcacttgtggcctatggggaaatacatcaaatgaggattataaaaattcagtagtggccaggcataggtggctcacgcctgtaatcccagcactttgggaggacgaggcaggcagatcatgacatcaggagattgagaccatcctggctaacacggtgaaaccctgtttctactaaaaatacaaaaaattagctgggtgtggtggcgggcgcctgtaggcccagctacttgggaggctgaggcaggaaaatggcgtgaacccgggaggcgtagctttcagtgagccgagatcgcgccgctgcactccagcctgggtgacagagcgagactccatctcaaaaaaaaaaaaaaaaaaaaaaaattcagtgatcgggaattgatgaagaaattgcttcattaagtgagtaaactctttatctagctcattctttgatctgtttggttttaggaggtttggtttatggagatcttgggtaaggggcatactccaaattcttggtatatcctctaataatagtctccctggtgtgctgcgttctctcaaaggttttaaatgcttgcatgcagccatctctaaaatgaaatatagtttcttttcaactggaataacaagagccaaaagaatctgcaaccatgaggacaccgtaacctatacctgacgtgctgagaatgaaaacccaaaataatagtaaccaagagtggcactaaggccctaagttttggtcccactctcactcaagtgaaaacctgaataaaggggaattttttaaagaaaattatgggaggccattgttttggactgagctcatgcactaggcccctacaaaccaaaccaaaccaaaccaaaatggagtcgctcgtgctaaaactttagggaaacgcatagattctacaagagaccaggttttgttttttttctcctgcatatctctataaaaaacatttctgacagcataggtatcaaccccctgaagttcccattaaatcttttagccaaattcatttcctctcgcctagataatcatcaagcttcagatgatcatgcaaccacggttccagccagttccaggtgaagacaccacccctggccatcaagaagctaccctgcctccacgagatagagcatggcgagagttccgtgatttccaataggtagggactatgccccaggtcggcatgaagcagttacagaagaaagctcttcagtccctctgcctcacataaagatttatggggatcaagtctctcagcggggagatgaggcaggagaatagggcctggaggcaggggacctaaggctgttttacgctgacttcctagaactaaattgaaaggaaaaccctcactttcaacgcctaagtaacaaaaggaccagaggctactccctttgaccttttctgcactacagatggaaaattggctgtggcaacaaattaggctgacttctggcctagtcttcgtttgcatacaagtataactttgttaacttcaccctagcctctgattggttgctttttgcaaccaatcagatatttgcacaggagtgtgacctttgtaacttcagtttagcctctggttgtctcctttctgcaaccaatcagatttatttcgggcgaccactccacttacatgaggtggccaatgggaaacttctagggggtatttgaaccaaagaagattctgtatccaggcccttgagcctctgctgaggccatctcccacagtgtggagtgtactttcgttttcagtaaacccttgctttcattcttttgttacttcattcttgctttgctttgctgggcattttatgcaattatttgttcaaaacgccaagaacctggacaacttgcaatcctgaccctctacgggtcacaaacccaagttgcacccaactggacaaatctccagtaatccatgttcagtggcgcctttatctctggaaggcgttttttcaaacagaaagggcgggagaaaagggctccaagacagggcttgattgaaaatgtggaaccctactgccaccgtgaggaaatcgtttaaagacggaatacgccatcatggcgtccttctcggaaagcctccctgtgggggaaaggctgatctgtaggcccccaggctatgtcttcctgccttttcctctaaggcctgaaaagagacagggacattggcggtatcttggtgtagaatctggagagtgcggggtttggagtgaaccagcagctgccaggaggtactggcacaggaagtcgtggagcggaaacttggttcctccggtgtggggaggacagtagggaaccagtcaaacacacatagaggctcttgtgggcatctgtctcttctacctgccctttggagcaagagtcagcaggctttcacttgctagcatcttgctatgggtcttggggtttctggtagcatcaatatcgctcacaaggaacacagttattccaagggaagtttacaggatttgctgttagaaccttcactctccaggttctacagcaaggtaccgccaatgtccacgtctcttttaaggccttagacgagaaggcagggactctgagcatggagcccaagcctcttccacctccccacagaccagaccttccccaacaggtagtcctcacaagacgacccatgtaatggcgtagggatccgttaaatgacatcctcgcgatggcggtagtgcatcagatatgccagaaagccctgtcttggagcaccgcccccttctcctgcccttcctgtctgaaaaaacgcgactcatagacaaaggcgcaaccaaacatggatgccttctatttgcccagtgtggagcctgctagtcttactgctgcactttttcattttgttttccacttgaaatcaaaccgaggcctaaagcaccggtcctcatcaggaatccagttcttccagaaattaaatatcctcctgacctactctgtgtgggtttgatttacttcagagttacaggtccagtaatttccgaggcatcaaactgtctccttcagggaatacattcagtggatgaactcacaaaaaagagaaaaggagccgggcgcggtggctcacgcctttaatcccagcactttgggaggccgaagctggcggatcacccgaggtcaggagttcgagaccattatggccagcatggcaaaaccctgtctctactaaaaatacaaaaattagccgggcgtggtggcacaggcctgtaatcccagctactccagaggaggaggcaggagaatcacttgaacctgggaggggaaggttgcagtaagcggagagcgcactattgcactccagcctgggcaacagagtgagagtgtctcaaaaaaaaaaaaagagagagagagagaaaagggctaaaagcttgaaagcttggaaaagaactccagcaaaaaatttaaaaatcccagaggtcttcgccctggctcccctgtcaggcatccagggaattcttcctattctaagagccttatgtggtacatcataggcaacaatttggcatgagccattagaggagaaaccaggtgacgctccttactgcatgccatatatactccaaatgccatgatactcatagaacatatgttcaattcatatcaaggtggctcagggtttcatctcatggtctcatcatttaacatcaaaacacagcatgtgcccgtgccattacatattcttcaagtattccctgagactttatggggtgtgtgtttgtgttcgtgtttgtgtgtgtctctgagagttttataattggtcttttaagtataaggattacagtattctccaactagtaaattaaagaataatgcttgacaaagattaagaaaaatccatgtattaacacagaaaaccgctaccatacaacttgtcaaggtaactcatgaacttatggattatttccatgcatctttcaaaatgtgcatacattaacttcatgcaaaaaaataaatctgtgtaaaaagtggattactgtgtacatagtggtttggatcagaccaaatgtgtattttaatgaaactttcagatgcatgaattaattcaaatgtcaccagtactaagtcttatatgtcaacatttcatgccttcaatataaataaaggtaaatcttaacatacagcctcaggaaaattactttagtaaagtagacaatatcagctctttgattttttacagctacatcactacacatttctaaaaaaaagttcatgaagagacaaagacatcagaaattatggctacctaacattttgctcaatttgtgtaaacaatttccactcttaaccatttgcttttggtttccattggatattaacctgagatgtaatccatgcaccctcatcaagcatctcatctttttaagaactcagtttctgcacaaccaaatcttcccatttctactctttttcactctgcatcatatctgcagtattttattgtgatatcaaatagtcttgtagtaatggggagagaccttaggtttccatgcctaaggagagaagaaaaaaaaaagctcacctctaaaggcttggagaagagcaaatctaggcaccaggccacgtggttcttgtcctgattccctactcaggttccccgggaattttactccatgttctaatctagtcagtaggccttatacattgagggggaggatgctatttagtggggcactaacataagggtacggatagctctcaagcctgacaagacacacacagccctacttgaatagacacaaacacaggaatgactgtaaatactaatcagattgatcacaggattttgtctcatagtttcattatttaacactgaattagaaatattttccagtgtcattaaatggctgtcacttaggactgtgccctatgactttcttgtgtatgtgtcttattgtttttcagttgggaatcagtcctatattttctcattagtaacaaagacatggaatttgcaaagaagttaaaaataaccatgtgctgatcaagagaaaagcaatgtcataaaactgtattaaacaatgatcattgtttccatatttcctctcattttttcaacactcagataaaaagttctatatatacagtcaaacaccacaataaatttacattttacttgaatttagatatataaataaagttgaagaattaaaagtttcacatctgattcctgaggtttttttattctcataagaaagttgcaatatctgaattttagacaataaaatatttgcaaaaacttcttgattggactattcatcaaaacataagttctccattttcacttttatatctaaaatatatgtatatttatacacacataaaatagaaacacgtttatatacaatagaaacatatgtattatacatacttatacctagaaaattaggatgtttaattcttctcaaatttttattcttaattctttccttaaaattttatctttgaaacctcaaaagaaagatagcaaaattcaataaatgatagttgaaataggcatctctcacattcagtcacctggaggtgtaacctaagaaaactgtaagatggatgcattcacacaactcacatgcagctagaatgctttattactgtctctgtttatataatgacaaattaaagttttgaatttgttggccaaaaataccatcttcaaacgtatactcattataacacctaccatgattaaatatatatagcattggccgggcccagtggctcactactgtaatcccaacactatgggaggccaaggcaggaggatagcttgagcccaggagttcaagaccattcctggcaatgtagtgagaccccgtatctacaaaaaatacaacaaataaccaggcatggtggcgtgcaacagaagccccagctatgtaggaggcggagatgggacgaccacctgagtccagggaggttgattctgcagtgacccatgatcatgccattgcactctcacctgggcaacaatgagacactgtcatatatatatatatatatatatatatatatatatatatttttttttttttaatattgttatatacctacagacagatataaatacacacacactcaacacagtttaaatataattggatgtatactgtttgaaatttgtacaaaatcttcagcattgtcttatatgccttgaatatatctacatccatatgtacttttgagtgcttggaatttttttatattttactctagaagaactttaagatattacaaagcagaaaacatgctgggtctcatatagtgagaagaaataatgacttttaaaatgtctgtgctaggtattatcatctgttcactctgcacatataatatggacttttataacctaatgttcaaattcccctatagtacaactgtttttgttttttaatgttggatatggggtttccctatgttgaccagtttgatctcgaaatcctggcctcaagcaatcctcccatgtcagcctcccaaagtgctaggattacaggcatgaggcaccaagcccagccacctcgtagtataactgttaaaacaagatttcttcactgataacttgagtacttttcaaatataattattcatggaaataatgacaggtttaaaattattggcactttttaaaactgagttggtaaaattcatataacataaaattaaccattaaaatgtgtgaaattcagtggcatttagtactttcacaatgcagtgcaagcactatctctatctattggcaaagcactttcattaccacaaaagaaaaccctggacccattaagcattccccattccactctctgcccagcccctggcaaacactcatctactttccctcactactgatcatcacaataagtggtcttttccaaagtcttgcttttttcacttagcgcgtttcaaatttcatgcattggttatctatcttattgacatctacctcttggatatggatcttcgctattgtaccttcatccacccaatttatcacctgaaggagacaatttgatgccatggaacttgctggacctgcaactgtgtgaagtaaatcatacccagatagactcagtgaggagtatatttaatttctgaaagaacaaaattcctgataagcacgggtggtttaagctgaattttgtttttagttggaaaaacaaaacaaaaccaaaaaaaaatcaacagttaagaccaggttgcaccaaactggacaaatctccaggcagctatgtttggtggcgcctttatctctggtttgcttatttcatagacgaagggcaagagaaaggcctcaaacatagggcttccctgaaaatgtgcaacactactactaccgtgaggaaatcgcttaaagacataatactccactagagcctccttcccaggaagcctcgctgtggggaaaggctgatctgttgggaggtgggagaggcttggcctccaggcgaggtcttcttgccttctcctctaacgcctgaagagtgacatagacattggtggtatcttggtgtagaacccggagagtgaggggcttggagtgaaccagcagctgccaggcggtcctggcacaggaagtcgtgggtcggggcctcagttcctcctggtgtgggcaggactgcaggaacccactcaaacacacattgaggcttttgtaggcatctgtctcttcttcctgtcccttggagcaagagtcagcaagctttctgatgttggcatcttgctatgggtctttgggtctctgtgaccaaacaacaggtttattcaaagggaagtttacaggatttgttattagaagcttcacactccaggttctatagcaagatattgccaatgtccaggtctcttttaaggccttagacaagtaggcaaggacgcccagcatggaggccaagcctctttcacctcttaccagaccacacctaccccaacaggtagtgctcagagaactctgtaatggcgttaaacgactataattcgttaaacgtcttcctcgtgatggcagtagtgctccagatatgccaagaagtcctgttacgtagccctcttctcccgcccttcctgtctgaaaaaacgccacacatagacaaagagccaccaaacatggatgtcttctattttgcccagtttggagccagctggtcttactgctgtgctttttctttttgttttccacttgaaatcaaaccaaggcctaaaccaaccaccctcatcaggaattttgttctttaagaaattattctactgacctagtctgtgtgggtttcatttacttcagagttacaggtccaataatttccgtggcatcaaactgtctttttcaggggatagcttcagtgtatgaacgcacaaaaaggagaaaagggctgaaagcttggaaaggaactccagcaacaatttaaaaatcccagagatcttggccctggctcccctgtcaggcatccagggaattcttcctattctaagagccttatgtggtacatcgtaggcaacaatttggcatgagccattagaggagaaaccaggtgacgctctttattgcatgccatgtatactccacatggcatgatactcatagtacatatgctcaattcctgtcaaggtgactcagagtttcaactcatggtctcatcatttaacatcaaaacacagcatgtgcccatgccactacatattcttcaagtattccctgagactttatgggctgtgtgtggttgtgtttgtgtgtgtctctgagagttttataatgtcttttaggtataagaattaactagtaaattaaagaataatgcttgacaaagattaagaaaaatccatgtattaataatgaagaaaaccactaccatacaactagtcaaggcaacttaagaacttttggattatttccaggaatatctttaaatatgtacatacattgttaatttcatgaaaaaataaatctgtattgaaagtggattactgtgtacactgtggtttggatcagatcaagtgtgcattttaacaaacctttgaggagggtgaattcatttgaatgtcaccagtacgaagtcttatatgtcaacatttcatgccttcaatatgagtaaaggtaaaccttaaaatagggcctcacgaatattactttagaaaagtagacacttatcatctttttgtttgaatttttaaagatgcattactatacgtttcaaaacaaaacgccatgaagagacaaagacaacagaaactacggatacctaatattttgctcaatatgtgtaaccattttccactcttaaccatttgcttttggcttccattggatattgaactgagatgagatccactcaccctcaacaagcatctcctctttttaagaactcagtttctgcacaaccaaatctccccacttctactctttttcattcagcatcctatcagcagtgttttattatgataacaaatagtcttgttgtattgggaacagaccttaaggatccatgcctaagaaagaattaaaaataaagcttacccccaaggtcttggagaagagcaaatctaggcactgggccacgtggttgttgtccttactccctccccaggttccctgggagttttactccatgttctgacctagtcattaggccttatatgttgagcgggaggccactatttagaggggctataacataagtgcccatgtaactcttaaacctgacaagacacacacagccctgtttgaatggacacaaacgaatgactataaatgctaatcagatggatcacaggattttgtctcatggtttcattattcaacattggaacagaaatattttccaatgtcattaaaaggctatgactggctgggtgtgctggctcacacctgtaatcccagcagtttgggaggccgaggtgggcagatcacttgaggtcaggaggtcgagataaacctggccaacatggtgaaaccctgcctctactaaaatacaaaaaaattagccaggtatggtggtgcatgcccataatcccagctacttgggaagctgaggcaggagaattgcttgaacccaaggcagaggttgcagtgagctaaggtcgtgccgatgcactccaccatgggtaacaaagtgagactccatccgtctcaaaacaaacaaaaaggctatgacttaggactgcctcttatgactttgttgtgtatgtgtcttactgtttttcacctaggaatcagtcctatactttcttattagtaaggaagacatggaatttgcaatgaagttaaaaaaaaccctttgggaggtgggggcaggtggatcacaaggtcaagagattgagaccatcctgccaacatggtgaaaccccatctctactaaaaacacaaaaattagctgagtctggtggtgcgcacctgtagtcccagctactcgggaggcggaggcaggagaatcacttgaacctgggaggcagaggttgcagtgagccgagatcaccccactgcactccagcctggcgacagagtaagactccctctcaaggaaaagaaagggggcggggggaggggggcggtggctcatgcctgtaatctcagcactgtgggagacctaggagggcagatcacctgatgtcgggagttcaagaccagactgaccaacatggtgaaaccccgtctctactaaaaatacaaaattagccaggtgtggtggcacatgcctgtaatctcagctacttgggaggctgaggcaagagaatcacttgaacctgggaggcagaggttgcggtgagccgagatcatgccattgcactccagcctgggcaacaagagcaaaactacgtctcaaaaaaaaaaaaaaaaggaaagaaataaaaataaaaataaccatgtgctgatccagagaaaaccaatgtaataaaactgtattaaacaatattaaccgtttccatatttactccaattttttacacacagatcaaaagttctatatatacagtcaaacacgacaataaatttacattttacttcaatttagctatatataaggttaaagaactaaaagtttcaccactgattccttaggagtttttgatattctcataaaaaatttgcaatatctgaactttagacaataaaatacttgcagagaacttgtgattggcctattcataaaaacataagatctcaacttgcacttttaaatcgaaaatatgtatgtatttacacatacataaacatataaatacatatttatatacaacataaacatatgtattatacatatttatacccctgaaaattaggatttttaatacttctcaaatttttactcctagttcttaccacaaaacattatctttaaaatttcaggctgggcgcagtggctcaagcctgtaatcccaggactttgggaggctgaggtgggcagatcacgaggtcaagagattgagaccaacctggccaacatggtgaaaccccgtctctactaaaaatacaaaaaaattagccaggcatggtggtgcatgcctatagtcccatctactcggggggctgaggcaggagaatcacttgaatccaggaggcagaggttgcagtgagctgagattgagccactgcactctagcctggtgacagagcgagactccatctcacacacacaaaaaagaaatttcaaaagaaggataacaaaattcaataaatggtagttgaaataggcatctctcacattccagtcacctagatgtgtaacctaagaaaactgtaagatggatgcattcacacaactcacatggagctagagtgcttcattagtgtctctgtttatataacgatgaattaaagatatgaatttactggtcaaaaatatcatcttcaaacatatactcactataacacctaccacgattaaaaagatatggcattggccgggcatggtggctcacaactgtaattctagcactttgggaggcctaggcaggtgcatagcttgagcctaggagttcaagtccagccctgacaatgtagagagaccccgtctcttcaaaaaatacaaaaaatagccaggcatggtgacctacaatggaagccctagctacgtaggaggcggaaatgggaggatcacctcagcccagggaggctgatgttgcagtgagccatgatcatgcctctacactccaccctgggcaacagagtaagatgctgtctaaaatatatatatatgcatatctgtgtgtatatatatatatatatatgtgtgtgtgtgtgtgtgtatatacatatgtgtgtgtatatacatatatgtgtatatatatatgtgtgtatatatacatatacatattcagcatcaccttatattctttgaatatatctacatcaatacatacttttgagtgcttgaaattttttatattttactctagaagaactgtaagaaattataaagtagaaaacttgtggtaggtcaaacatagtaagaagaaataatcactttttaaaggtctgtgctaggtactatgatctgttccctatatatacataatatggacttttataaactaatgttcaaattcccctgtagtataacttcttgttgttgtttatttttttttttttgtatttttcattttagatatggggtttcactctgttgaccaggctgatctcgaaccactggtctcaagcgatcctcccatcttggactcccaaagtgctaggattacaggcacgaggcaccttgactggccaccatgtactatagctgttaaaacaagtttgtttcactgataactggagtacttttcaaatataattaataattcatggaaataatgatagctttaaaagtattggcacttttaaaaactgagtttgtaaacttcatataacataaaattaaccattaaaatgtattaatttcaatggcatttaggacactcacaatgcagtgcaagcattaccactatgtagtggcaaatcattttcactaccacaaaagaaaatcctggacccattagttagtcattccccattccactctctgcccagcccctggcaaacactcatctgatttccctcactactgatcatcacaacaagtggccttgttcatcttgttgtgggaaccaggagaccagagagaccaatgggtggaacaggaggattttactaggtggtcaccgactcagcagattaacatccaaaggctgagccccaaaccaagagagggcttgacttttatacatatatctgaaaagggcccaaaacctgtaaggccggtaagcaagcttacagcagaacaaaggcagtttatcaaacagtgacaggttttacagttcaggcatgtcttgtgacctttgccataactgcacagctggaaaacaggaacttacaaaatccttacaagcttgcagaaacagttacaaaaatagttgtgagagcagaacaaagaataatggtatggggaaagaatttcaaaggggaaactgataaaaagaacttgtttttctttcttttttttttttagatgaagtcttgctcttgtcccccaggctggagtgcaatggtgtgatctcggttcactgcaacctcctcctcccgggttcaagtgattctcctgtctcagccttccaagtagctgggattacagctgcctgccaacatgcctggctaatttttgtatttttagtagagacggggtttcaccatgttggccaggctggtcttgaactcctgatctcaggtgatcctcccacctcggcctcccaaagtgctggggttacaggtgtgagccaccgtgcctggccaaataacttgtttttcttatccctgcttctagagcccactccttctcggcccccactctgctgatagtgctatcaaagtcctgacagagccctacttatcgctgggccttggagtgagtcagcccagcacagagaaccagcttttctctcccttttttttttcttttacatctcctgcttcagtactgcttctttcacttagcgcttcaaacttcatgaattggttttctatctctttgatatctgtctcttagatatctatctcttagatatctttctttgtttttgtaccttcatccatccaatgtatcacctgaaggagacaatttgataccatggaacttccaggccttgtaactgtgtgaggtaaatcatacccagatagcttcagtgaggagtatatttaatttctgaaacaacaggattcttgagaagcatgggtggtttaggcctcattttgctttcagatggaaaaaaaaaaaaagtaaaaattcaacagtaagaccaggttgcaccaaactggacaaatctccaggtagccatattgggtggcatctttgtctctgggtggcgttttttcagacgggaagggcgggagtaaagggctccaagatagggattccttaataatgtgaagcacgactgccaccgtgaggaaatcctttgaagacacaatacgccattacagcgtccttcccagaaagacttgctgtggggggaagtctgaactgtgggaggtggcagacgcttgggctccaggctaggtcttctagctttctcctctaagacctgaagagaggccttaacattggtagtagcttggtgtagaaccaggagagtgaggggcttgtagtgaaccagcagctgccaggcgatcctggcacaggaagacgtagggcggggcctcggttcctccaagtgtgggcaggactgaaggcacccattcaaacacacatggaggctcttgtgggcatctgtctcttcttcctgtcccttggagcaagagtcagcaggctttctcgaactagcatcttgctacgggtctttgggtctctggtagcaccagtaccgcgcacaaacaacaggtttattccagggaagtttacaggatttggtattagaaccttcacactccaggttctataccaagacaccgccaaagtcctggtgtcctttaaggccttagacgagaaggctaggactcccagcatggagcaagccttttccacctccccacagagaacttccccaacaagtagtcctcaggagaacaccgtaatggcgtagggatttgttaaacaacatcctcgcgatggcagtagtgcttcaggtatgggacgaagcactgttccagagccctcttttcccgcccctcctgtctgaaaaaacgccacctatagacaaaggccctgcagaatgggtgccttacatttagcccagtttgcagccagctagtcttactgctgagctttttcttttggtttccagttcaaatgaaaccaaggcctaaaccacccgccctcatcaggaatcttgatctgtgttaaaagtggattactgtgtacactgtgatttggatcacaccaagtgtatttttttttttttttttgagacggagtctccgctctgtcgcccaggctggagtgcagtggtgtatctctgctcactgcaagctccgcctcccgggttcacgccattctcctgcctcagcctcccgcctagctgggtctacaggcgcccgccaccacgccctgctaattttttgtactttttagtagagacggcgtttcaccgtgttagccaggaaggtctcgatctcttgacctcgtgatccgcccgccttggtctcccaaagtgctgggattacaggtgtgagccaccgcgcccacccaccccgagtgtgtattttaacaaacatttgaggatcgtgattttattagaatgtcaccagtactaactcttttttttttttttttttttttttttttgagatagagtctcgctctgtcgcccaggctggcgtgcagtggtgggatctccgctcactgcaaggtctgcatcccgggttcaagggattctcctgcctcagcctcctgagcagctgggattacaggcgtgcaccaccacgcccatggagtttcaccatgttggtcaggctggtctcgaaatcccgacctcgtgatccgctggcctcagcctcccaaagtgctgggattacaggtgtgagccaccccacccggcccagtactaagtcttatatctcaacatttcacaccttcaatataaataaaggtaaatcttaacatagggcctcaggaatattactttagtaaagtagacactatcagttttttgtggaatttttacagatacatcactacatgtttctaaaaaaaggccatgaagagacaaagacaccagaaactatggctccccaacattttgctcaatttttgtaaacatattacactcagcaatttgcttttagtttccattggatattaaactgagatgtaatccactcaccctcatcaagcatctcctccttttaataacttagtttctgcacaaccaagtcttcccatttctactcttactcactcagcatcatatctatagtgttttattatgatatcaagtactcttgtagtattctggaaagaccttagctttccatgcctaaggagagaagaaaaaaaaagcttacccctaaggtcttggagaagagcaaatctaggcacaaggccacgtgtttcttgtcctgacttcctccccaggttccctgggagttttactccatattctgacctagtcattaggccttatatgttgagggaggggcggctatttagtggggctctaacataagggctcagatagctctcaattctgacaagacacacacaaccctacttgaatggacacaaatacaggaatgactataagtcctaatcagatgggtcacgggattttgtctcatagtttcattatttaacattggaacagaaatattttccagtgtcattacaaggctatgacttacaactgtgttctatgactttgttgtgtatgtgtcttactgtttttcagttaggaatcagtcctatattttcttattagtaacaaagacatggaatttgcaaagtgaaaagtaaccaactgctgatgaagagaaatgcgacgtcataaaactgtgtattaaacactgataaccgtttccatatttactcatatttttttcttttcttttttttttttttttttgagagggagtctcgctctgttgcctaggttggagtgcattggcgctatcttggcttactgcaagctctacctcccgagttcacgccattctcctgcctcagcctcccaagtacctgggactacaggcgcctgccaacacgccccgctaattttttgtatttttagtagagacggggtttcaccatgttggccaggatggtctcgatctcctgacctcatgatccacccacctcggtctcccaaagtgctgggattacaggcatgagccactgtgcctggcctactcctattttttcaatacacagataaaaaagttctatatatacagtcaaacaccacaataaatttacattttacttgaatttatccatacataatgatgaagattaagatttccacatctgattcttaaggagttcttgatattctcataaaaatttgcaatatctgaattttttacaataaaatatttgcaaagaacttcttgtttggactattcatcaaaacataagttctgaacttgcacttttaaatttaatatatatatttatacatacataaacatataaatccatatttatatacaatataaacatatgtatgttacatacttatacctatgaaaataaggatttttaattcttcttcaaattttattgctaattcttaccttaaaattttatctctaaaatctcaaaaggataaaaaatttaataaatggtaattgaaataggcatctctcactttcagtcagctagatgtgtaacctaagaaaactgtaagatggatgcattcacacagcttacatgcagctagaatgcttcattagtgtctctgtttatataacgatgcattaaaaatgtgaatttgttcaccaaaaatgccatcttcaaacatatactcagtataacatctaccacgattaaaaatttatagcattggctgggcgcggtggcttacaactgtaattgcagcactttgggaggccgaggcaggtagacagcttgagcccacgagttcaataccagccctggcaatgtaggtagaacctgtgtctacaaaaaatacaaactatagctgggcatggtggggtacaacagaagccccaggtacgtataggaggcagaggtggcaagatcacctgatcccagggagattgatgctgcattgatccatgatcatcatgccactgcactccagcctaggcaacagtgagacagtctcatatatatatatggcatttaaaattttgtaatatatctccagacagatataaatacacacacacttgatacagtttaaatataattggatgcataatgtttgaaatttgtacaaaatctgcagcatcactttatgctctttgaatatatctacatcaatatatacttttgagtgctttaatttttttgtattttattctacaagaactttaagaaattataaagcagaaaacatatggtaggtcaaacatagtgagaagaaataatcacttttccctatgcacatataatatggactttttaaaactaatgttcaatttcctctgtagtataacaggttttttactttttattttagatatgggttttcgttgccgggcaggttagctcacgcctgtaatcccagcactttgggaggctgaggcgggcggatcacaaggtaaggagattgagaccatcctggctaaaatggtgaaacccgtctctactaaaaatacaaaaaattagccgggtgtggcggcacacgcctgtagtcccacctacttgggaggctgaggcaggagaattgcttgaacccaggaggcggaggttgcagtgagcccagatcgcgccactgcactccagcctgggcgacaaagcgggattctgtctcaaaaaaaaaaaaaagatatggggtttcgctatgttgaccaggctgacctcgaactcctgacctcaagccatcctcctatctcagactcccaaagtgctaggattataggcatgaggtgtcatgcccggccacccagtagtataactgttataaacaagttttcttcactgataatttgagcacttttctaatataattaattatccatagaaataatgataggtttaaaagtattggcactttttagaactgagtttgtaaaattcatataacataaaattagccattaaaatgtgtgaaattgagtggcatttagtacattcaagatgccgtgcaagcattaccactacatagtggcaaatcattttcattaccacaaaacaaaaccccggacccattaagcagtcattccgcattgggctctctctctgcccagtccctgacaaacactcatctgctttccctcactactgatcataacaagtggccgttttcaacttccttctttcacttagcttgtttcaaatttcatgtattggttatctatctctttgatatctacctttgttgttgtacctgcatccacacaatttatcaccttaaggagacaattttatgccatgaaacttgctggacctgtaactgtgtgaagtaaatcatacccagatagactcagtgaggagtgtatttaatttctgaaagaacaagattcctgatgaacctgggtggtttaggcctcattttgttttcacacggagtaaaaaaaggaaaaattcaacagtaagaccaggttgcaccaaactggacaaatctccaggaagccatgttgggtggtgcctttgtctctgggtggcgtttttttcagccaggaagggcgggagaaaagggcgccaagagagggctttcttgaaaatatggagtactactgccaccgtgaggaaatcgtttaataacgcaatacgccattatagcttctttccgggaagcctggctgtgggggaaggtctgatctgtgcggtggtggaagaggtttgggctccaggctaggtcttcttggcttctcctggaactcctgaagagaaacctgtacattggcgatatcttggtgtagaacctggagagtgaggggcttgcaatgaagcagcagctgcccagcggtcctggcacaggaagtcgtggggcggggtctcggttcctagtgtgggcaggactgcaggaacccactcaaacacaaatggaggctcttgggggcatctgtctcatgtaattgccccttggagcaagagtcagctggctttcatgtgctgtcatcttgctatgggtctttgggtctctggtagcataagtaccgcgcaaaatcaacaaaggtattcaaagggaagtttacaggatttgctattagaaccttcactctccaggttctataccaaaatatcgccaatgtccatgtctcttttaaggccttagacaagaaggcaaggactcccagcctggagcccaagcctcttccacttccccacagaccagtccttccccaacaggtagtcctcagagaacgctgtaataatggcgtagggattcactaaacgacttcctcgcgatggcagtagtgctccagatatgccaagaagccctgtctttgagccaaggtcttccgcccttcctgtctgagaaaacgccacctatagacaaatcacaaccaaacgtggatgccttctattttgcccagttggtagtcagctggtcttactgctgcactttttctttttgttttgcgcttgaaatcaaaccaaggcctaaaccacctgcctccatcaggaatcttgatctttcaaaaatgaaatctcctcctgacctagtctgtgtaggtttgatttacttcagagttacaggaccagtaatttccgtggcatcaaactgtctctttcaggggataaattcggtggatggacatacaaaaagaaaagggcttaaagcttggaaaagatctttccagtaaacaattaaaaaatcccagggggaagggtgcggtggctcacgcctgtaattacggcactttaggaggccaaagcgggcagattgactgaggtcaggagttggagaccagcctggcctacgtggtgaaactccgtttctactaaaaatgcaaaaattagctgggggtggtggcgggcgtctgtaatctcagctactcaagagtctcaggtaggagaattgtttgaacccaggagacagaggttgcagtgagccgagattgtgccactgcgctccagcctgggcgacagagcaagactcggtctcaaaaaaaaaaaaaaaaaaaaaaatcccagggatcttggacctggctccctgatcagacatccagggagttcttcgtattctaagagccttctgtagtgcattgtaggcaacaatttcgcatgagccattagaggagaaaccaggttacgcacattaccacatgccatatatattccaaatgacatgatactcatagtacatatgtttaattcctgtcaaggtggctcagagtttcatctcatggtctcatcatttaacatcaaaacacagcatgtcaccatgccattacatattcttcaaatatttcctgagaatttatggggtgtgtgtgttcgtgtttgtgtttgtgtgtgtctctgaaagttttataatttgtcttttaggtataaggattacagtactctccaactagtaaattgaagcataatgcttgacaaagattaagaaaaatccatgtattaataatgaagaaaactgctaccatacaacttgtcaaggcaactcatgaacttttggattatttccatgcatatctttcaatatgtacatacactgttaatttcatgcaaaaaataaatgtgttaaaagtggattactgtgcacactgtggtgtggataagaccaagtgtgtattttaccgaatctttcagatgtgtgaattcatttgaatgtcaaccgtactaagtttatatgtcaacatgtcacgccttcaatataaataaaggtaaatcttaaaatagggcctcaggaatattgccttagaaaagtagacactatcgccgggcgtagtggctcacgcctgtaatcccagcactttgggaggccgaggcgggtagatcacaaggtcaggagatcaagaccattctggctaacacggtgaaaccctgtctctactaaaaatacaaaaaaaaaaaaaaattagtggggcatggtggcgggcgcctgtagtcccagctacttgggaggctgaggcaggagaatggcgtgaacccgggagggagcttgcagtgagccgagattgtaccactgcactccagcctgggcgacagagcgagacactgcctcaaaaaaaaaaaaaaagaaagaaagaaagaaagaaaagtagacactatcagctttttgtctgaatgtttacagatacatccctacatgtttcaataaaaaggccatgaagagacaaagacaccagaaactatgactacctaacatttcgctcaatttgtgtaaacatattccactcttagccatttgcttttggtttccattggatattaaactgagaggttatccactcaccctcataaagtatctcctctctttaagaactcagtttctgcacaaccaagtcttcccatttctactctttttcactcagcatcgtatctgcagtattttattatgatgtcaaagagtcttcttgtattgggaacagaccttagtgatccatgcctaaggagagaagagaaaaaaagcttacccttaaggtcttggagaagagcaaatctaggcaccaggccatgtggttcttgtcctgactgcctacccaggttccctagcagttctactccatatctgacctaggcagtaggccttacatgttgagggggaggccgatatgtagtggagctctaacataagggtacggatagctctccagcctgacaagacccacacagccctatttgaatggacacaaatacacaaatgactataaatgctaatcagatagataacaggattttgtctcatggtttcattatttaacattggaacagaaatattttccagtgtctttaaaaggctgtgacttacgactgtgtcctgtgactttgttttgtatgtgtcttattgtttttcagttaggaatcagtcctgtattttctcattattaacaaagccatggaacttgcaaagaagataaaaataaccatgtgctgatcaggagaaaatcgatgccataaaattgtgtattaaacactgataaacagttccatattatgggccggacgtggtggctcacacctgtaatcccagcagtttgggaggccgagacgggcagaacacgaggtcaggagtttgagaccagcctggccagcatggtgaaaccccatctctactaaaaatacaaaaaattagccgggcatggtggcgcatgcctgtagtcccagctactcagaaggctgaggcagaattgcttgaacccagcaggcggaggctgtagtgagccgagatcacgccattgcattccagcctgggcgacagagcgagactctgtttcaaaaccaaacaaacgaacagttccatatttactcccattttttcaacacagagaaaaagttctatctatacagttaaacacgacaataaatttacattttagttgaatttagctatacataaggttgaagaaagtttcacatatgattcctgagtttttcatattctcataaaaaatttgcaatatctaaatttaagacaataaaatatttgcagagaacttcttgattggactattcatgaaaacataagtactcggccggtcgcggtggctcacgccaataatcctagcactttgggaggccgaggcgggtggatcacaaggtcaagagttcgagaccagcctggccaatatggtgaaacctgactctactaaaaatacaaaaattagctgggcttggtggcaggcacctgtaatcccagctactcaggaggctgaggcagtagaatcacttgaacacgggaggcggaggttgtagtgagcagagattgtgcctctgtactctagcctctgcgacagagtgagactccatctcaaaacaaacaaacaaaaaataagtactcaatttgtacttttaagtataatatatatatttatacacatataaacatataaatacatatttatatgcaatatgaacatatgtattatacacacttataccgctgaaaactgaaatttttaattctccttgaatttttattcctaattctttccttaaaaattgatctttgaaatctcaaaggaaagataacaaaactcaataaatgatagttgaaataggcatctctcacattcagtcaccttgatgtgtgacctaagaaaactgtaagatggatgcattcacacaactcacatgccactagaatgcttcattagtgtctctgtttatataatgatgaattaaagacacgatttgttggccaaaaataccatcttcaaacatatactcactataacacctatcaggattaaaaatatatagcattggccagacacagtggctcacaactgtaatcccagcactttgggaggccaaggaggtggatagcttgagcccaggagttcaagactagtcctggcaatgtagtgagaccccgtgtctacaaaaaatccaaaaaatagccaggcatggtggcttgcaatggaaaccccagctacttaggtagtggaggtaggaggaccacaggagcccagggaggttgatactgcggtgaaccatgatcatgccattgcactccagcctgggcaacagagtgagacgctgtctaaaaaaaaaaaaaaatatatatatatatatatatatatatatatatatatatatatatggcatttaaaattttgtaatatacctacagatataaatacagacacaacacagtttactctaaatataattggattcatattgtttgaaattttctacaaaatcttcagcatcaccttatactctttgaatgtatctacatcagtatttacttttgagtgtttgaatttttttcatattttactctagaactttaagaaattataaagccgaaaacatatgataggtcaaccacagtgaaaagaaataatcaattttccctatgcacatataatatggactttataaactaatgttcaaattcccctgtagtgcaactggttctttttctttctttctttctttttttaaattttagatatggggtttcgctatgttgaccagaccgatctcgaactcctggcctcaagcgatccacccaactctgcctcccaaagtgctagtattagaggcatgaggcaccaagcctggctgccttgtagtatatctgttaaaacaagttttcttcactgaaaacttgagtacttttcaaatataattaattattcatggaaataatgataggtttaaaagtactggcacttttaaaaactgagtttgtataattcataaaacataaaattaaccattaaaatgtgtgaaatttagtggcatttagtatattcacaatgcagtgcaagcattaccactatctagtggcaaatcattttcattacattcaacttgctggacctgtaactgtgtgaggtaaatcatacccagatagactcagtgagcagtatatttaatttctgaaagaacaagattcttgatgagcatgggtggtttaggcctcattttgtttagagatggaaaaaaaaaaagcgaaaattcaacagtaagaccaggttgcaccaaactggacaaatctccaggcagccatattgggtggcgcctttgtctctgagtggcgttttttcagacgggaagggtgggagaaaagggcgccaagatagggattccttgaaaatgtgaagcacgactgccaccgtgaggaaatcgtttaaagacacaatacgccattacagcgtccttcctggaaagattcgctgtggggaaaagtctgaacagtgggaggtggcagacgcttgggctccaggctaggtcttcttgctttctcctctaaggcctgaagagaggccttaacattggcggtatcttggtgtagaacctggagtgcgatgggctcgaagtcaaccagcagctgccaggaggtcccggcacaggaaatcgtggggccgggccccagttcctcctggtgtgggcaggactgcaggaacccactcaaacacacatggaggctcttgcgggcatctatctcttattcctgtcccttggagcaagagtcagccaacgttctcgtgctggctatgggtctttgggtctctggtagcatcagtaccgcgcacatagaacagggttattccaggggaagtttataggatttgctttcagaacgttcaatctccatgttctataccaagataccgcccatatccaggtctcttttaaggccttagaggagaagacaaggactcctacctagcatggagcccaagcctcttccacctccccacagaccagaccttggccaacaggtagtcctcacggggaagaacactgtaatggtggaagggtttttttttaaacgatatccgcgcgatggcagtattgctccacatacaggaagaagccccggttcaaagtcctcttctcccgcccttcctgcctcaaaaaaaagccacccatagacaagcgttccaaacctggatgctttatatcttgcagtttggagcttgccggtcttactgctgcactttttctttttattttcaacttgaaatcaaactaaaggccgggcgcggtggctcacgcctgtaatcccagcactttgggaggccaaggagggcagatcacctgaggtcgggaattcgagaccagcctgaccaacatggagaaaccccgtctgtattaaaaatacaaaattagccgggtgtggtgacgcatgcctgtaatccctgctactcgggaggctgagataggagaatcgcttgaacccaggaggcagaggttgagggatcgcgccactgcactccagcctgggcaacaagagagaaactccgtctcaaataaaaaaaaaaaaagaagaaagaaagaaaagaaaacaaatcaaaccaaggcctaaaccacctgcccttgttctatcaaaaattacatattctcctgaactagtctgtgttagtttgatttgcttcagagttacaggtccagtaatttccgtggcatcaaaccgtctctttcagcggataaattcggtgggtgaaaacacaaaaaggagaaaagggctgaaagcagaaaagatcttctccggcaaacaatttaaaaatcccagaggtcggccgggcgtggtggctcacgactgtaatcctagcactttgagaggccaaggcgggcggatcacgagttcaagagatcgagactatcctggccaacatggtgaaaccccatctctactaaaaatacaaaaattagccgggcgtggtggtgggctgtagtcccagctactcgggaggctgaggcagtagaatcgcttgaaaccgggaggtggaggttgcagtgagccgagatcgcaccactgtactccagcctggggacacagcgagactccgtctcaaaaaaacaaaacaaaacaaaacaaaaaatcccagaggtctttgacctggctcccctgtgagacatccagggagttctccctattctgagagccttctgagccttctgtggtgcattgtaggcaacaatttggcatgagccactagaggagaaaccaggtgatgctcattactgcatgccatatatactccacatggcatgatattcaaagtacatatgtttaattcctgtcacggttactccgagtttcgtctaatggtctcatcgtttaacatcaaaacacaacatgtgcccatgccattaaatattcttcaagtatttcctgagactttatggactgtgtgtgtttataattatatgtttctctgagagttttataatttgtcttttaggtgtaaggattacagtattctccaaatagtaaattaaagaataatgcttgacaaatattaagaatagtccatgtattaataatgaagaaaaccgctacaatacaacttgtcaaggcaactcatttggattatttccatgcatatctttcaataagtacattgttaatttcagcaaaaaataaatctgtattaaaagtggattactgtgtacactgtgatttggatcagaccaagtgtgtattttaagaaacctttgaggagcgtgaattcatttgaatgtccacagtactaagtcttatttttcaacatttcatgccttcactgtaaataaaggtaaatctttttttttttttttgagacagagttttgctctttcgcccaggctggagtgcagaggcacgatctcggctcactgcaacctctgccttctggtttcaagtgattctcctgcctcagcctcccgagtagctgggattacaggtgtgtgccaccacaccctgctaatttttgtattttcagtagagacggggtttcactatgttggccaggctggtctcaatctcctgacctcgtgatcggcccaccttggcctcccaaagcactgggattgcaggcatgagccactgcacctggcaaataaagataaatcttaaaatttgacctcaagaatattactttagtaaagtagacactatcagctttttgtatgaatgtgtacacatacatgactacacgtttcaaaaagaaggccatgaagaaacaaagacaccagaaactatggctacccaatattttgctcaattcgtgtaaacatattccactcttagccatttgcttttggtttccattggatattaaacagtgatgtaatccactcaccctcatcaagcatctcctcttttcaagaactcagttactgcacaaccaagtcttcccatttctactcttactcagcatcatatctgcagtgttttattatgatgtcaaatagtcctgtagttttgggtacagaccttaggtttccatgcctaaggagagaagaaaaaaaaaagttttacccctaaggtctttcagaagagcaaatctaggcaccaggctatgtggttcttgtcctgactccctacccaggttccctaggagttttactgcacgatctgacctagtcattaggccttatatgttgagagggaggctgatatttagtggggctctaacataagggttcggacagctctccagcctgagaaaacacacacagccctacttgaatggacacaaatacaggaatgactataaattctaatcagatggatcacagaattttgtctcatggtttcattatttaacattggaacagaaattttttccagtgtcattaaatggctatgacttaagactgtcctataactttgttgtacatgtgtcttactctttttcattaggaataagtcctatattttctcattagtgacaagacatagaacttgcaaagtaaaacagtaaccatatgctgatgaagagaaaagcaatgtcataaaactatatattaaacactgataaccatttccatattcactccctttttttcaatacacagataaaaagttctatgtatacagtcaaacacacaataaatttacattttagctgaatttagctatacttaaggttgaagaattaaaagtttcacatctgattgttgaggagtttttgatattctcataaaacatttgtaatatctgaattttggacaataaaatatttgcaaagaacttcttgattggactattcatcaaaacataagttctcaattttcacttttaaatctaaaaaatacagatacatatataaatatatatacatatattaattttttttagatggagtctcactctgtctcccaggctggtctcgaactcctgacctcaggtgatccgcccgccgcagcctcccaaagtgcagggattacaggcatgagtcaccgcacctggctaaaaaatatatatatatttaaacatacataaacatataaatacatatttatatacaatataaacagatgtataatacatacttatacctctgaaaattagaatttttaattcttctagaattcttattcctaattcttaccttaaaactttatctttaaaatcttcaaagaaagataacaaaattcaacaaattgtagttgaaataggcatctcacacatttagtcacctagatgtgtaacctaagaaaactgtacggccaggtgcggttgctcatgcctgtaatcccagcactttaggaggccaaggtgagcggatcacgaggtcaggagttcaagaccagcctgaccaacatggtgaaaccccgtctccactaaaaatacaaaaattaactgggcatggtgacgcatgcctgtaatcccagctacttgggaggctgaggctggggaattgcttgaaccgggacgcaggaggtggaggttgcagtgagccgagatcacgccactgaactccagcctgggctacagagcgagactctgtctcacaaaaacaaaaaacaaaaaacaaaaacaaaaacaaaaagaaaactgtaagatggatgcattcacaccactcacatgcagctagaatgcttcattagtgtctctgtttatataatgatgaattgaagatatgaatttgttggccaaaaatgccatcttcaaacatatactcagtataacatgtaccatgattaaaaatgtatagcattggctgggcatagtggttcacaactgtaatcccagcactttgggaggccaaggcaggtggacagcttgagcccaggagttcaaggtcagctctggcaatgtagtgagacctcgtctatacaaaaaatacaaaaaatagctgagcatggtggtatgcaatggaagccccagctacatagaaggcagaggtgggaggaccacctgagcccagggaggttgatgctgtagtaagccataatcataccactgcactccagcctgggcaacagagtgagacactgtctaaaaaatcatacatatacagcattaaaaattttgtaatatacctagacagatataaatacacacacactcgacacagtttaaatataattggatgcataatgtttgaaattttgtacaaaatcttcagtatcaccttatactcattgaatatatctacatcaatatatacgtttgaatgcttgtaattttttcatattttactctaggagaactttatgaaattataaagtagaaaacatatggtaggtcaaacataatggaagaaataatcacttttgcctatgcacatataatatggacttttataaactaatgttcaaattcccctgtagtataactgttttttatttatatttttaaaaaaaattttagatatggggcttcgctatgttgatcaggttgatcttgatctcctggcctagagtgatgctcccatctcagcctcccaaagtgctaggattagaggcatgaggcaccgtgcccggccaccttgtagtataacagttaaaataagttttcttcactgataacttgagtacttctcaaatagaattaattattcatggaaataatgacagctttaaaagtattggcactttttaaaactgagtttgtaaagttcacataacataaaattaaccattaaaatgtgtgaaattcagtggtatttagtacattcacaatgcagtgcaagtactatctctattggcaaagcattttcattaccacaaaagaaaaccctggacccattaagcagtcattccccattccactctctgcccagcccctgacaaacattcatctactttccctcactactgatcatctcaataagtggtctttttagtcttgtttccttcacttaagctgttttcaaatttcttccattctctctctctgtttttttttgttgttgttgtttagatggagtcttgctctgttgcccaggcttgagtgcagtggtgcaatctcggctcactgcaacctccgcctcctgggttcaagcgattctcctgcctcagcctccccagtagctgggattacaggcgcatgccactatgcccgataatttttgtgttttttagtagagacggggtttcaccatgttggccaggctggtctggaactcctgacctcatgatccatccacctcggcttcccaaagtgctgacattacaggcatgagccatcgcgcccgaccatgatatcttatctcttcgatataaattgggttatctatctttttgtttctaggttttaagagttctttatatgtactgggtattagaagtttctagataattgatatacaaatgtttcctcacattgtgtcaattggcttttcaagttcttgatagtgtatattgatgcaaaaagtttttaatttcaggaaagtccaatttatattttcttttgttaattggtgcttttggtggtatagctaaaaaatcattgccaaatctaaagtcgtgacgatttatccctatagtgtccctgaaggtttcatagctttagctcttacatttagaaatttgatacattttgacttatttttggatataatgtgaggcagaggactaaattcatccttttttttttttttttttttgagacggagtctcactctgtcacccaggatccttaaattttttctttcttttctttttttgagacggagtctctctctgtcacccaggctgtagtgcagtggcacaatctccgctgactgcaagctccgcctcccgggttcacgccattctcctgcctcagcttcctgagtagctgggactacaggcgcccgccaccacgcccggctattttttttttttgtattgtttagtagagacagggtttcgccgcgttagtcaggatggtctggatctcctgaccttgtgatccgcccacctcagcctcccaaagtgctggattactggcgtgagccacagcgcccggcctaaattcatccttttgcatatgcataaccagttgtctatgtactatttgttaaagactctattaattactcataaaatgacctgaataactttgtcaaaaatgaattgaccacaacgtctgggtttatttccagactctccatctcttccattaatcactgtgtgtattcttatttaattatcacactgctttgattactctagcttttctagtaagttttgaaatatagaagtgtgagtcttctaccttggtttttcttattcaaactttacattggttatcagatctctggcaatttaataggatctttagaatttgtgctccttttttacaaaaacaaacaatgctcattgggataataatgattgcattaaatttatagatctcagtgggtagtattggtatgttaaaaatattttgtcttccaacccactaccacaggatgtccttttttaaaatcaaggttatctttaacttcttctccaatattttgtgattttcaatgtataagactttcatctattaactattgtcctaaaaatatgattcattttgatgctattgtaaagggaattgctttcttaatttaattttcagattattcattgctagtgtacacaaataaaactacaactgatttttccgagttaatgttctatcctgctgtgcttgctagatactgttcactagctctaatattgttgttttctggatttttaagcattttttacaagatcatcgtatttgtgaagagaaataatttccattttttcttttcaattgggatgtattttatatatcttcattgcctgacgccctgggctaaaattttaagtataatgttcaatacaagtggcaaaagtaggtgttcttctcctgttcctgattttagaagcaaagctttcagtcgttccctcttgactatattattagctgtaggtttttaattaatgccccatatatcgtgctgagaaaatgatcttctaattatacattattaactgttttgagttgcttttctggagagatggactacagaaagtgtctactgcaccattgtcattgatgtcacttttgccatctgtttttgaatttactgaaacactcatgcttcttcaaaatgtgcctgacacaatagtcatacatgaaaaagtaaagttgttacagttagttacataggcaataagcagggcaggaaaggactctcccccacccaatagaaatgtcacatgatggttcagcaatgatcacattgtctccctaaaaatgataatttggtagcaagggagaggcaatctcctgatggcccacacctgataatattaaaagtgtgaactgaatgcaggccccagggagaagcagcttcttgggcatgcgtattaagacacaaaatggcgaaatatgatgttccgggtacatgccaccagaaaaaggaaaaaagcctcagatgggcatgtgtataactccctaaacacactgcacagtgctcaattccaaagggtaaggagggcactgcgcatgcggaaagctcaccctaaaggaagaatcatgagcaagaggtaagcctataaggtcccatgatcaaggttaaaaggtctttttgttctcttggccactcaggcacccacttggatctcttccaagggttctttctttcctttctttcctgttctaaagcctgttaaataaacttccactcctgctctgaatcttgcctcagtctctttttctgctttatgaccctcagtcgagttatttctttggaggaggcaaggactgaagttgctgtcgacctatatagatatgccgcctgttactcggggtaactcggttcactgccaccgctaacaaagtgagatcatgggtaatgctacctcccacagacaagcacttttaaaatgtggattaattttcaatccttttcactccttttgtttcccatccctttatgtgtaacaactccactaagaaagtaaataaacaaaaaataaaaaggaacggccgggcacagttgcttaagcctgtaatccagcacactggggggccgagacgggctgatcacatgaagtcaggagttcgagaccaccctgacccacatggtgaaaccccgtctctactaaaaatacaaaaattagccaaacgtggtggagcccatctgtagtctcagctgttcggggggctgagacaagagaatcccatcaacctgggagacggaggatgcagtgagctgagatcgtgctgctgcactccaggctgggcgacagagcaagactccatctaaaaaaacaaaaccaaaaaacaactctactagaaaatgtaaaactttaggtcctttcagtctttagacaactagatgcccttgagactatcagcaaacatactggctcctgctttatcacacctggaacaggcctgtctttggtgttctcatactgctgcaacaaaggactgtgatacagtaacactgcctgaaagcttactaactcttgctccaagggacagaacagaacacacacacccatcccccccacacacagcatctaatgtctcaggaaatccctgaagaatatgtaatgcatgggaacatgctgtgttctggtgttaaatgttgagaccatgagatgaaactgagtgatctcgatagggactgaacatagggactatgaggatcacgccatgtggagcatataggccaaggagtaatgaccagatggtccttactctatgacttaaaccaaatttttgcctacaatgcaacacatgaggctagaacatgaactctctggttgtccgagaggggaaccaggtcaaagaccaccaggatttgtaaactgtttgccaaagatcttccccaagtttcaaataaatttttcctaattgtaccttcatccacccagtttatcacctgaaggagacaatttgatgccatggaacttgctggacctgtaacagtgtgaagtaaatcatacccagatagtctcagtgaggagtatatttaatttctgaaagaacaagattcgtgaggagcatgggtggtttaggcctcattttgttttcagatggaaagaaaatagcaaaaattcaacagtaagacaaggtcgtaccaaactggacaaatctcctggtggccatgatccgtggggcctttgtctctgggtagcattttttcagacagaaaaggcgggagaagaaagctcctagacagagcttccaagaaaatatgaagcactactgccaccgtgaggaaatagtttgaagacagaatccgccattacagtattcttccctggaagcctcgctgtgggggaaggtctaatctatgctgaggtggaagaggattgggctccaggctaggtcttgttgccttctcctctaaggtcttaagagaggcctggacattggcggtatcttggtgtagaacctggagagtgaggggcttggagtgaagcagcagctgccaggcagtcctggcacaggaatttccggggcagggcctctatttccccagttgtttgctggacaacaggaacccactcaaacacacatgcaggctcttgtgggcatctgtctcctgttcctgccccttggagcaagagttggcaggctttcatgtgcttgcatcttgctacaggtctttgggtctctggtagcatcagtaccgtgtacaaggaacaggattttaccaagcgacattcacagtatttactttccttcactctccaggttctataccaagacactaccaatgtccaggtctttttttttttttgacggagtctcactgtgttgcctaggctggagtgcaatggcgagatctcggctcactgcaacctccccctcccgggttcaagcgattctcagcttcctgagtagctgggattacaggcgcctgccaccacatccgactaatttttgtatttttagtagagatggggttttaccatgctggccaggctggtcctaaactcccgacctcagacgatccgcccgcctcagcctcccaaagtgtggtctttgaggatagggcaaggatgagcagcatggagctcaagcctcttccccctccccacaggccagaccttctccaacaggtggaaggactgtcttcaggggaaggacattgacatggcttaggcatagggcgtagggcgttgcttaactatgtcctaacggtggcagtagtgctctagatgtgctaacaggtgtcgtggagccttcttctcccgcccttcttgtctgaaaaaacgccacccaaagacaaaggcacaaggaaacatggctgccttgctttttgcccagtttggagtcatctggtcttactgtggcaattttgcttttgttttccatctgaaatcaaaccaaggccgaaaccacccaccctcatcagaaatcttatttgttcagacatttaaaatcctcctaacctagtctatatgattacgatttacctcagatttataggtccagtactttccatggcatcaaactgtctccctcgggggataaatttggggatgaaagcacagcgataaaattgcttgaggctccgagaccaccaggatttacaaatcctggtggtctctattctggctccccttccagacaaccagggagttcttcatgttttagctcatgtgttgcattgcagacaacaatttggcatgaaccatagaggagggaccagatagctgtcattactgcatgccatatgcgctccacatggcatgatactcatactacatatcttcagttcctatcaaggttattcacagtttcatctcatggtctcgtcatttaacatcaaaactcggcatgttcccatgacactacatagtcttcaagtatttcctgagactttatggggtgtgtctgtttgtgtgtgtgtgtgtgtgcatgtgtattttataatttgtcttttagatataagtcttacagtattctcccactagttaattaaagaataatgcttgacaaagattgagaaaaatcaatgtactaataaagatggaaagcactacaatacaatttgtctaggcaataaataaataaatttggattatttccatgcactcccaggcttattaggaagaggaaattcccgcctaataaaagaatatatttccatgcatatattcccgcctaataaattttggtcagactggttgatctcaaaaaccctgtctcctgataagatgttatcaatgacaatggtgcctgaaacttcattagcaattttaatttcccctcggtcctgtgatctctccctgcctccacttgccttgtgatattctactaccttgtaaagtacttgatgtctgtgacccacacctattcgcacactccctccccttttgaaaatccctaataaaaacttgctggtttttgcagcctgtggggcatctcagaacctaccgacatgtgatgtcttccccagaagcccagctttaaaatttctctcttttgtactctgtccctttatttctcaagctggccgacgcttaaggaaaatagaaaagaacctacgtgaatatcggggctggttccccgatatatacacatcattttttttcttttttgagactaaaactctctctgtctcccagcaggagtgaaatggcgagatctcggctcattgcaacctccagttcaagcgattctcctgcctcagcctcctgaatagctgggattacaagtgcatgccactaggcctggttacttggttttttttgtttgttggttttgtttttttttttttttgagacggagtctcgctctgtcacccaagctggagtgcagtgatgtgatctctgctcagtgcaacctccgtctcccaggttcaagtgattctcctccctcagccttctgagtagctgggactaaaagcatatgccacctgcccggctaatttttgtgtttttagtagagacagagtttcaccatgttagccagaatggtctccatctcccaacctcgtgatctgcccgcctaggcctcccaaagtgctgggattacaggcgtgagccacctggaccatccccaattgttttgtatttttagtagacacaggatttcaccatgttggccaggctgttctccaactcctcaccgcaagtgatccaatcaccctggcctcccaaagtgctgggattacaggtgtgagccaccacgcccggctatatatacattcctaatttcatgcaaataacaaatctgtattgaaattgggtcacactctacactgtggtttggagcagatcaagtgtgtattttaacaaagctttcaggaggatgaattcatttgaatatcataaatggtaaatgttttcaacattgcaagccttcagtgtaaatgaaggtaactctgaaaaatatatgctcagaaacattcctttagaaatgtagacaccattcattttttgtttaaatttttacagatgcatcacaacgtgcgtattggctctctagaatacatacatgactatatgtttggtttaaggttatgacatgttagaagtagagtaaaatgcactgggcgcggtggctcatgcctgtaatcccagcactttgagaggccgaggcgggcggatcatgaggtcaggagatcgagaccttcctggctaacacggtgaaacctcgtctctactaaaaatacaaaaaattagccagacgtggtggctggcgtctgtagtcccagctactcaggaggctgaggcaggagaatggtgtgaacccaggaagcagggcttgcagtgagccgagattgcgccactgcactccagcctgggtgaaagagcgagactccacctcaaaaaaaaaaaaaaaaaaaagagtagagtaaaatacactttactttgttatttattatttatcttatggtgtggtaggtttaatccacaaggttcaacaatttgctattctccctaaatcagaggcaaggaatggctgtttacgaggatacagagaatgcaattaagattttatgatggctaaagggactacctggtgcaaatgaatgacatgtatccaacctaaatgggaatgataggctcattgcccctccacactatcttccattgcagaataaaccaatcaacctccttgtcactaccactggtacttggctaggtgtgatttccttgccaggcttctatccactgcccaggcacacagcctctattaaagatagttagcaaggggtgaataaaagatcacttagcctaaagaattctaggtttggggacaccagcatttctaccttcagatatgagacactgtcccataggtaggtctgtattcttccatgaaaatggtcaggtcaaactattcctccataggaggtagtttagcagatgtctaagtctactttaggtgaaatactctggggaggtaagatatcaagggtcatggagaaatgcttcccagagagtctccaagacacttgtgcatgccaatagcatttatgtatgcagatcatcattcaactagacaaagtcaaagatgtcaaaaaagctaggttaccctagaatgccttaccctggaatgcctgcctgaatcctcagaggccaggagaggtcatacctgaacaagctcttgaagcactgtaatgtcacagtgcagaaccagactaacattaattcctttcattaagaattcagatactaaaataataaattctgaggaagaatgtcatgaggatcaagtcacccatacacttttagtcaccattttgattctcaattatgagtcataaagtatctagaggtctccacaccaaaggttggatatcttcattaggaaatagatttgaagctgctacagaaaatactagctaggatgcagtagataatgatttgctcaggcctaaacaatgccatacttaccaaggacatcgaacagaaaagagccacctatctgccctccttgagagaactgagatgacatcggcgtcctattatgacaaaagactttctcctgaacctataacgtcacagaagctgctggcttgtgcgctcagataattgcttaggccttccattgcatttttggccttcatcctctttagcatatcagctctcctaaaagatgatctggcccacataggcatctcagtgtatccttactgctctacagaggtccttctagctataggcaatggtggttagaattttagtgtattgaggaccatgtgagtgacgctgacttcagatagatggttcctggaattggcctgtcattgccagccaacactgctgctataaatgtcacagccccacaacacaaggacaaccaggttgcctaaagctcccaagggcatattcataacataaatgccccaagggtctgtacttggctgtatcattttctagccttgtccccactatgagaaaacaggccctgtcctctacttcctgtgccaaaacttcctggaagcagctggctcagtcctgctccctcactcagcagatacttcacggagactttgcatttgttcattgcttctgccaggcctcagagaaaaggataggaagatcaacttgtgtctcgggtctgttcagccttcactggcttttccttcaattgctagggctcacatggaggaaacgctcacggctttggatgctacgaaactgtttccgcacgatggcagtattgtacgggagaagccaactgactttgctctaggcgctattctcccgcccatcacatttcaaaaaaaggccaagaagagacaaagacaccagaaactagaactacttagcagtttgctcaatttgtgtaaacttattccactcttagcattttgcttttgttttccattggatattaaaccgaggtgtgatccactcaccctcatcaatcatctcctcttttcatgaactcagtatctgcacaaccaatcttctcatttatactcttcttcactcagtattatatctgctgtgttttcttacatcaaattgtcttatagtactggggcagacctcagggatccatgcctaaggaaacaacaaacaaacaaagaaatgttaacacctaaggtcttggagaagagcaaatctaggcaccaggccatgtggttcatttgtttttttttttgagacagagtcttgctctgttgcccaggctggagtgcagtggcgctatctcggctcactgtaagctccgcctcccgggttcacgccattctcctgcctcagcctcctgagtagcagggactacaggcgcccgccaccacgaccggctaattttttttttttttttttttttttttttttttttttttttagtagagacggggtttcaccgcattagccaggatggtctggatctcctgacctcctgatccgactgcctcggcctcccaaagtgctaggattacaggcgtgaaccaccgagcccggccaggccatgtggttcttgtcctgactccctacccaggttccctaggagttccatttcatgttctgatccaggcattgggccttatatgttgagtgggaggctgccatttagtggagctctaagataagggaccaggtagttctcaagcttgacagagacacagaacccgattcgaatggacacaaacacaggaatgactataaattttaatcagatggatcacaggattttgtctcatggtttcattatttaacgttggaacacaaacattttcctgtgtcattaaatggccatggcttaagactgccctataactttgctgtgtatatgtgttactgttttccagttaggattcagtcctatattttctcattagtaacaaaaaggtggaatttgcaaagaagtaaaaaaaaaaaacccatgtgctgatcaagagaaaagcagtctcataaaactgtatattaaacactgatacccttttccatatttattccatttttcaatacatagataaaaagttctatatatagtcaacacaatgaatttacatttaaattggatttagctatgcactgcattttagtatgaatattccatagtatgaatgaagattttcattctaaaatttgatttctgaccagtttttgacattgtcatataaaatttgcaatttctgaattttggacaataaaatatttgcaaagaactatgtgattggactagtcattaagaattaagatctcaccttgcttttttaatctataaaatctatttatacatacataaacacatatataaatatatatattttacatagttatgcctctgaaaattaggattttaaaattattcttgaatttttatctctaattcttaccttcaaattttatctttaaaatctcaaaagaaagaaaacaaaattcaataaatgataattgaaataggcacatctcatattcagtcacttagatgtgaaccccagtaaaactttaagatggatgtattcacaccactcacatgaagctataatgtttcattaatgtctctgtttatgtaactatgaattaaagatatgaatttattggtcaaaaatatcatattcaaatgcatgctcagtataacactgaccatgatataaaatatatggcattggccaggcgtggtggctcacaactctaatcctggcactcttggaggctgaggcaggaggatcacttgagcctgagagttcaagaccaatttagtaattagcaattttggcaatgtagcgagtccctgtctctaaaaaaaaaaaaaaaaaaaaaaaatagccaggcatggtgtcatgcacctgtagtcccagctactcaggaagtggaggtgaaaggatcacctgagtccagggaggttgaggctgcactgagccatgatcctgccactgcactccagtctgggcaacagagtctgatcctgtgtaaaaaaaacatatatatggtatttaaacatttgtatatgcatatgaacagatatgaatacacacagagtaccgcacacattttactttcaatataactggattcatactatttgaaatttggtccaaaatcctcagcatcaccttataatctttgaatatatccatatcaatatatacttctgagtgcttgagtttttttatattttactctagaagaattttaagaattataagcagaaaacatatggtaggtcaaacacagtgagaagaaataatcacttttaaaatgtttgggctacgtattatgatttgttcctttgcacatataatatgtacatttataaactaatgttcaaattcccctgtagtataattgttaaaacaagttgttaaaaccctggacccatgaagcagtcattccccatgccactctatgccgagcccctggcaaacactcatctgctttccctcactactgatcatgacaataaggggcctttttcattttgcttttttcacttagcatgttttcagatttcatccatgttgtaactgataacttgagtacttttcaaatataattagttattcctggaaataatgataggtttaaaaatattggcactttttaaaactgtgttggtataattcatgtaacatataattaaccattaaaatgtgtgaaattcagcggcatttagtacattcacaatgcagtgcaagcactaactctgtgtagtggcaaataattttcattaccacaaaagaaaaccctggacccatgaagcagtcattccccatgccactctatgccgagcccctggcaaacactcatctgctttccctcactactgatcatcacaataaggggcctttttcattttgcttttttcacttagcatgttttcagatttcatccatgttgtaatatatgtcagtacttcatttctttttgtagctgaataatatccatatgtatatatcacattttgtttatccattcatcaagtgattgatgtttgcttgtgttcaccttttgggtattgttaataaatatatacagtgagtatatacatgtacttttttgagtatttgttttcaattgtttgcggagtatacttaggagtagagctgctaggtcatacggttatttctatgtttaaatttttgaaggactgataaacttttccatagcagatgcgcaatttagcatacccaccttcactgcagaagggttccaatttctccgcctccccacccatatttgttctttttaagtaatatccattctagtgggtgttaagtggtatcatgaagtggttctgatttacatttctgaaaacactaataatggaagtatgttttcatgtaattgttggtcatttgtgtatcttctttggagaattgtctatttaagacctttgcctattcttaaaattgatgcattatagttgtacatatttatggggtacacatggtattttgatgtatgcataaaatgtgtgataaccaaaaaaggaaaactgggatactcattccctactgcatttattatttgtgttcgggaacatttcaaatgtgttttatctatttggaaataaccattaaattattgtcaactatagatgtcctaactgtgctgttgaacactagaacttactccttctgtctaactgtatttttgtagccattaacaaacctgtcttcattcccctctcttcctaacttctggtacccaccattctactctatacataccatgagatggattcctttagctcctacatatgagtgaggacatgtgataatttgtctttctgtatctggcttatttcacttaacatagtgtcctaaagttccattcatgttgctgcagatgacagaattccattcttttttctggctaaataatcttccattttatatgtatgccacagtttcttaatccattcatccattaatgaacagttaggttgattccatatcttgactactgtgaataatgctgcaataaacatgagaatgcatatatatatatatatagtactgatttcccagcagtgggattgctacatcatatggtaattctatttttagtatttttgggaaactccatcctgtgtctcatagaggctgtattaatgtacattgcaggcaacattatacaagcattcctctttctctgcttactagccaacacctgttactctctgtcttttttgtaagagtcatttgagctggggaaatacggtaccccactgtagttttgatttacatttccctgatgattagtgatgttgagcattttttcatgtatccgttagccatttgtgtgcctttctttcagaaatgtctattcagatcatttgcccatttgtaaatcagatatatttgttttttttctattgagctgagcttttttaagtttgcaaatatattctctcttactgtaggttgtctcctcactttattgttttctttgctgggcagaagcgttctagcttgatttactctcatttgtccatttttgctttgattgccagtgctttttgaggtctcccacaaaaaaatcattgcccaaaatgatgtcttaaagcatttccgcagtctcttcttctggtactttcatattttcgggtcttttcttatatttgttgagccttgttctgtggcctaacacatgctctatactggagcgtgttccatgtgctgactgatgacaagaatgtatattctacagcaattggatgaaacattttgtaaatgtcagttaagttcatttggtctagagtacagtttaattccaatgtttctttgtctggataagctgtccattactgaaagtggggtactgaagtctcccactattgttgtacacctgtctatctctccgtttagatctccaaatgtttgccttatctatttgtgtgttccagtgttgggtacgtacatattttaaattgttatatcctcttactgaattggcatcttcattttttgttttgttttgttttttttgtttgtttgttttttgagtctggctctgtcgcccaggctggagtgcagtggcgcgatctccgctcactgcaagctccccctcccaggttatgccattctcctgcctcagcctctggagcagctgggactacgggcgcctgccaccacgcccggctaatttttgtatttttagtagagacgggatttcaccgtgttggccaggaaggtctcgatctgctagcctcatgatccgtccgcctcggcctcccaaagtgttgggattacaggcgtgagccaccgcgcccggccggcatctttattgttatacagtgaccttctttgtctctctctacagtttttgactttaatctaatttatataagtctagcctttcctgttctttttccattcctgttcattttcatgttgttgctgatgtcccgctctggtttgagatcttctttgcctgagtaaaagagaagtccccagatttaatgcactggggttgctagcttcaactccactttcagtctcagactaccccctcagggatttttcctcctacaggcagtcaggatgcctcctagggattgaggcaagaataggatccctgcaaaggacaccaaaatgggagagaagctagctctctgccttgatctcacattttacagaggaaactgtgaaccaaggggtacttttctttttttcttttcttccttttttttggtgggggggggagcagggggatggaatctcactctgtcacccaggctggagtgcagtggcgcaatctgggctcactgcaacatctgcctcccaggttcaagtaattctcctgtctcagcttcccgagttgctgggattataggggcacaccaccacgcccggctaatttttgtatttttagtagagacggggtttcaccatattggtcagtctggtctcaaactcctgacctcaggtgatccacctgcctcggcctaccaaagtgctgggattataggcgtgagccaccgcgcccagtcaagggggacttttctacatggtgcctagcagccttgggttggggagtcatggagagagaagtccattagtctttctagctgctcatactttttcacttccttatagccccatggatagtcacagtctcaatgttcagttctggaatattgcttctagtaatcttgtctctacacagctgtttttacttttctttgaggtaaagtcagatcacttctgctataccatgttggtgatatcactctccctttgcctattttttaaaaattgggttatttgtctgtttattgttgagttttaagagttatttgtttttattggatattagaagtttttagataattgatttggaaatatttcctcccattctgtaagttggcttttcaagttctgaattgtgtactttgatgcaaaaagtttttaatttcagggaagtccaatttattttttcttttgtcattgctgcttttggtggtatagctaataaatcattgccaaatctaaagttgtgaagatgtatccctatagtttccctgaaggttttatagctttagctcttatatttagaaatttgatatattttgagttaatttttgcatataatgtgaggtagaggtctaaattcatccttttgcatgtagataaccagttgtctaagtactatttgttaaagactctattaactactcataaaatgaccttaataactttgtcacaaatgaattgaccacagtgtctgagtttatttccaggctctccatcttttccattaatcactgtgtgtattcttatttgattatcacactgctttgattactccagctttcctaataagttttgaaatccagaagtgtgagtcttccaccttggtttttcttattcagagtttacattggttattcagatctcttgcaattcaataggatctttaggatttgtgttccttttttacaaaaaaaatgctcattggataacaataaggattacattaaatctatagatctctatgggtagtattgccacgttaaaaatatttagtcttcagacccattaccacaggatgttctttattaaaatttaggttatctttaacttctccattattttgtgattttcagtgtacaagactttcatctatttagttaattattgtcctgaaattatgattcattttgatgctattgtaaatggaattgctttcttaattgaattttcagattattcattgctagtgtacacaactactactgatttttccaagttaatgttctgtcctgcagttgcttgctggatcttgttcactacctctaatactgtttttctgggtttttgagcttttttttttttttttgactggagtcttgctctgtcgcccagactggagtacaatggcacgattccggctcactgcaacctctgcctcctgggttcaaacgattctcccacctcagcctcccgagtagctggaattacaggcacccgccatcatgcccgggtaatttttgtatttttgtagagacggggtttcaccatgttggccaggctggtcttgaactcctgatcttaggtgattcacatgcctcagcctcccgaagtgctgggattacaggtgcgagtcactgcgcctggcagcattttttataagatcactgtatttgtgaagagaaataatttccattttttcttttcaactgggatattttttatatatcttcattgcctgatgaccccagctagattttaagtataatgtttaagagaagcggcaaaagtgggcatttttctcctgttcatgattttaggagcaaagttttcagtctacctcttgactatattattagctgtaggttttaataaatgccccatatatcgtgctgagaaaatgatcttctaattacatattatagattgttttgagttgcttttctggagagatggactacagaaagtgtctactgcaccattgtcattgatgtcacttttgctacctgtttttgaatttgtaggaacactcatccttcttcaaaatgtgcctgacaaaatagtcacatatgaaaaagtagttacagatagataggcaatgagcacggcaggaaagggctctccctgacccagtaggaatgtcacatgatggttcggcaatgatcacattgcccctctaaaaatgataatttggtagcctgggagagacaatctcctgatgatccacatctgttaatattaaaagtacgaattgaatgcaggccacagggagaagcagcttcttgggcatgcgtattaagacacaaaatggcgaaatatgatgttccgggtacatgccaccagaaaaaagaaaaaagcctcagatgggcatgtgtataactccctaaacacactgcacagtgctcaattccaaagggtaaggagggcactgcgcatgcggaaagctcaccctaaaggaagaatcatgagcaagaggtaagcctataaggtcccatgatcaaggttaaaaggtctttttgttctcttggccattcaggcacccacttggatctcttccaagggttctttctttcctttctttcctgttctaaagcctgttaaataaacttccactcctgctctgaatcttgcctcagtctcttttcctgctttatgctcctcagtgaagttctttcttctgaggcgccaggactgaagttcctctggacctatatggatatgccgcctgttactcggggtaactcggttcactgccaccgctaacaaagtgagatcatgggtaatgctacctcccacagacaagcacttttaaaatgtggattaattttcaatccttttcactccttttgtttcccatccctttatgtgtaacaactccactaaataaataaataaataaatagaatggccgggcacagtggcttacgcctgtaatccagcacattgggaggccaaaacgggatgatcacctgaggtcaggagttcaagaccagcttggcccacatggtgaaaccccgtctctactaaaaatacaaaaattagccgaacttggtggaacccacctttagtcccagttgttcgggaggctgagacaagagaatcccttcaacctgggagacggaggatgcagtgagctgagatcgtgctgctgcactccaggctgggcgacagagcaagactccatctaaaaaaacaaaaccaaaaaacaactctactagaagatgtaaaactttaggtcctttcagtctttagacaactagatgcccttgagactatcagcaaacatactggctcctgctttatcacacctggaacaggcctgtctttggtgttctcatactgctgcaacaaaggactgtgatacagtaacactgcctgaaagcctgctaactcttgctccaagggacaggacagaacacacacacccatcccccccacacacagcatctaatgtctcaggaaatccctgaagagtatgtaatgcatgggaacatgctgtgttctggtgttaaatgttgagaccatgagatgaaactgagtgatctcgataggaactgaacatagggactatgaggatcacgccatgtggagcatataggccagggagttatgactgctatctggtccttactctgtggctcatgccaaattgttgactacaaacaacacttgaggctagaacatgaagaactcctagttttctgggagggaaaccaggtcaaagaccatcaggatttgtaaattgtttgccaaagatctcttcctagtttcaaataattttttccttattgcacttttatccaccaagtttatcacctgaaggagacaatttgatgccatggaacttgctggactgtaactgtgtgaagtaaatcctatccagatggaacttgctggactgtaactgtgtgaagtaaatcctatccagatagacacagtgaggagtatatttaatttctgaaagaacaagattcctgaggagcatgggtagttcaggcctcattttgttttcagatggacagaaaaatagcaaaaattcaacagtaagacaaggttgcaccaaacaggacaaatctccatgcagccagatttggtggcgcctttttcctctgagtggcgttttttcagacataaaaggcgggggaagagtgcgccaagatagggcttccatgaaaaatgtgaatcactactgccaccgtgaggaaattgtttaaagacagaatccgccatcacacactccttcccaggaagctatgggggaaggtctcaattgggccgaggtggaagaggattgggctccagactaggtcttgttgccttctcctctcaggtcttaagagagctctggacattgacggtatcttggtgtagaaactggacagtaaggggcttggagtgaggcagcggctgccaggcggccccggcacaggaagtcgggagcggggcctcggttcctcctggtttgggcaggacagcaggaacccactcaaagtcgaattcttgctcttgtgggaatctgtctcctgttcctgccccttagagcaagagctggcgggctttcccatggtgtcatcttgctacaggtctttgggtctcttgcggcatcagtatccgcccacaattgacagggttcctccaagggaaatttacaggatttgctttccttcactatccaggttctataccaagacaccgccaaagtccaaatctcttttaaggcgttagacgagaaggcaaggaggatcagcatggatcccaggccttttctacctccccacagaccagaccttctccaacaggtagccctcaggggaaggacgttgacgtggcgtagggtgtctttaaactatcaccttacgatgggactagtgctctagatgtgccaagatgtgtcttggattccctcttctcccgccctccctgtctgaaaaaacgccacccagacacaaaggcacaagaaaatatggctgccttgttttttgcccagtttggagtcatctggtcttactgtgtcacttttgtttcccatctgaaatcaaaccaaggcctaaaccacccaccctcatcgggaatcttactccttcagaaacttaaaatcttcctaacctagtctatatgattatgaattacctcagacttacaggtccagtagtctccatggcatcaaactgcctcctcaggggataaatttggggatgagggcacaaggataaaactgcttgaacctcagaggagatcttttccagcaaacaagttacagaccttggtggtctctgacctggctccccttcccgacaaccaggaagttcttcatgttctaccgcatgtgttgcattgtaggcaacaatttggcaagaaccatagaggaggaaccagaaagctgtcattgctacatgccatatgtgctccacatggcatgatactcatactacatatgttcagttcctgtcgaggttactcagagtttcatctcatggtctcatcatttaacatcaaaacacggcatgatcccatgacactacatattcttcaggtatttcctgagactttaagtggtgtgtctgtttgtgtgtgtgtgtgtgtgtgtgtgtgtgtgtgtctatttttaaataatttgtattttagatataagtcttacagtattctcctactggttaattaaagaataatgcttgacaaagattgagaaaaatcaatgtactaataaagatgaaaagcactacgatacaatttgtcaaggcaaaaaataaccatttggattatttccatatatataatatatatatggagtatttccatatatataaaatatatatatggagtatttccatatatataaaatatatatatggagtatttccatatatataaaatatatatatggagtatttccatatatataaaatatatatggagtatttccatatatatataatatatatatggagtatttccatatatatatatatagaaatatatacatatatatatacacatagagaaatatatacatatatatatatatatatatatatacacacatacactttttctctttggggggagcgaaactttttctgtcacccaggctacagtgcaacggcgcagtctcggctcattgcaacctccaggttcaagcaaatctcctgcctcagtctccttagtagctgggattacaagcgcaggccaccagacctgattaattgttctgcatttttagtagacatggggtttcgccatgttggccaggctggtctcgaactcctgacctcaaggcatccaaaatccttagcctcccaaagtcctgggattacaagtgtgacccactgcacccagctatagatacattcctaatttcatgcaaataataaatctgtattgaaattgggttacactttacattgtagtttggagcagatcacatgtatattttaacaaagctttcaggagcatgaattcatttaaatatcatcaatactaagtgttgttttcaacatttcaagccttcaatgtaaatgaaggaaaatctgaaaaatatatgttcaaaaacattcctttagaaaagtagacagtatttatttatttataattttttttttttgagatggagtttcgctcttgttgcccaggctggagtgcaatggcttgatctcggctcaccgcaacttctgcctcccaggttcaagcgattctcctgcctcagcctcccaagtagctgggattacaggcatgcgccaccaggcccggctaaatttgtatttttattagagatggggtttctccatgttggtcaggctggtctcaaactcctgacctcaggtgatctgcccaccctggcctccctaagtgctgggattagaggcgtgagccactgcacctggccaattttttgtttaaattataacagatgcatcacaatgtgcattttggctctctagaatacatatttgactacatgtttggtttaaggttctgacatgttagaagtagagtaacatacactttactttgtcatttatcttaccgtgtggtaagtttaatcctcaaggttctataatttttcttttctccctaaatcagaggcagggaatggctgtttatgaggccacagagaatgcaattaagatcttgtgatgggccaggcacggtggctcatgcctgtaatcccagcgctttgcgaggccaaggcaggtggatcacaaggacaggagttcgagaccagcctggccaatatggtgaaaaccccgtctctactgaaaatacaaaaattagctgtgtgtggtggcgcatgcctgtaatcccagctacttgggaggcagaggcaggagagttggttgaacccgggaggcggaggttgcagtgagctgagatcatgccagtgcactccagcctgggtgacagaaggtgactccgcctcaaaaaaaaaaatgtgaaggataaagggactatctggtgtagatgaatgacatgtacccaacctaaatgggaatgataggctcattgcccctccacactacctttcattgcagaataaaccaatcaacctccttgtcactaccactggaacttggctaggtgtgatttcctttccaggcttccatccactgcccaggcacatagcctctttattaaagatagttagcaaggggtgaataaaagaccacttagcctaaagaattctaggattggcaccaccagcctttctaccttcagatatgaggtactgttccataggtaggtctgtattcttccatgaaaatggtcgagtcaaactattcctccataggaggcagtttagcagatgtctaagtctattttaggtgaaatactctggggaggtaagatatcctttttgtcctttccaggaacaaggatcatggagaaatgcttcccctagcgtctccaaggcattcatgcatgccaatagtatctatgtctgcagatcatcattcaactcaacaaaaccagctagagagagagctagacacagtcaaagatgtcaaaaaagccaggctaccctagaatgccttaccctggaatgcctgcctgaatcctcagaggccaggagaggtcatacctgaacaagctcttgaagcactgtaatgtcacagtgcagaaccagactaacattaattcctttcattaagaattcagatactgaaataataaattctgaggaagaatgtcatgaggaataagtcacccatacaattttagccactcttattgattcctcaattatgagtcatagagtttctggaggtctccacaccaaaggttgtatgtcttcatcaggaaatagctttgaagctgatacagaaaatactagctaggatgaggtaaataatgatttgctcaggcctaaacaatgccatccttctcagggacatccaacagaagagagctacctatgtggcctccttgacagaaatgagatgtcatcggggtcccattatgacaaaagactttctcctgaacttataaagtcacagaagctgctggcttgtgcgctcagataattgcttaggccttccatcacattcttggccttcatccacttcagcaaatcggctctgctaaaagatgatctggcccacataggcatgtcagtgtatcctcactcctctatagaggtccctctagttgtaggcaatggtgtttagaatttttgtgtatcgaggaccatgtgaatgacactggcttcagatagattgtccctggaactgtcctgtccattgcaatctaacgatgctgctataaatgtcacagctgcataacacagggacagccagattgcctaaaactcccaagggcatattcataacataaatgccccaggggtctgcacttggctctgtcatcttctagtcttgtccccactatgaggaaactgaggccctgtcctctatttcctgtaccaggagttcctggaaacagttggcttagtcctggtccctcactcagcagatacttcactaagactttgcatttgtctattgcttatgctaggcctcagagaaaagggtaggaatgccaacttgtgtcttgggtggcttttccttccgcaactgctagggcttacatgcaggaaacgctcacggctttggacgctatgaaactatttccgcacgatggcagtattgtacgagaaaagccaactaactttgctccaggagctcttctcccgcccatcacgtttcaaaaaaaaggccaagaagagacaaagacaccagaaactatggctacctaacattttgctacatttgcgtaatggtattccacttttggcttctgctggatattaaactgaggtgtaatccactcaccctcatcaagcatctcctcttttcaagaactcagtttccgctcaaccaagtcttcccatttctactcttcttcactcagcattgtttctgcagtgttctattatgatatcaaattgtcttgtcgtattggggaccgacctcagggatccatgtctaaagagaaaggaaaaaaaacatgttgacatctgaggtcttggaggacagcaaatctgggcaccaggccacgtgtttcttctcctgactccctacccaggttccctgggaggtttactccatgttcagacctagtcagtaggccttgtatgttgagagggaggtcgctatttagtggggctctaacataagagtccagatagctctcaagcttgacagacacacacaaccctacttgaatgtacataaatacaggaatgactataaatgctaatcagatggatcccaggattttgtcttacagtttcattatataacagtgtaacacaaacattttcctgggtcattaaactgcaatggcttacaactatgtcctatgagtttgctgtgtatgtgtgttactgtttatcagttaggaatcagtcctgtattttcacattagtaacaaagaggtgggattcgcaaagaagctaaaaaaaatgtggtgatcaagagaaaagcaatgccatacaactgtgtattaaacactgaaggctgggcgcggtggttcacgccaataatcccagcactttgggaggccaaggcaggcggatcacttgaggtcaggagatcgagaccagcctgaccaacatggcgaaacctcgcctttactaaaaatataaaaattagctgggcgtggtgtcacatgcctataatctcagctactcgggaggctgagacaggagaatcgcttgaaccgggaggtggaggttgcagtgagcaaagatcgcaccattgcactccaggctgggcaacaagagcgagaatccgtctcaaaaaataaaaataaaaaacactgataccctttttcgtatttgctcccactttcaatacatagataaaagttctatatatacagtcaaacagtcaaacaccacagtaaatttacatttaaattggattcaggccaggagcagtggctcatgcctgtaatcccaacattttgggaggccgagtcgggcggatcacttgaggtcaggagtttgagaccagcctgggcaccatgttgaaatgccgtgtctactgaaaatacaaaaataagccaggtgtggtggcgagtacctataatcacacctactcggaaggttaaggcaggagaatcgcttgaatccgggaggccaaggttgcagtgaactgacatcacaccactgcactcccacctgggcaacggagggagggcctgtctcagaaaaaaaaaaaaaaaaaaaattggatttagctatgtattgtaaagtaaaaattttcattctaaaatttggttcctgaccaatttttgacattgtcatataaaatttgcaatttctatattttagacaataaattatttgcaaagaacttcgtgattatactagtcattaaaaaataagttgtttgctctttttaatctaaaaatgtgtttatatgtatataaacacataaatatttacatatcatataaatatgtatattatacatacttatacctctgaaaattaggattttaagattattcttgagattttagctctaattcttaccttcaaattttatctttaaaaactcaaaagaagcaaaacaacatccaatacatgataattgaattaggcatctctcacattcagtcacttagatgtgaaccctaagaaaactgtaagatggatgtattcacaccactcacatgcagctacaatgtttcattaatgtctgtttatataactatgaattaaagatatgaatttgttggccaaaaatatcatattcaaacatatactcactataacactgaccatgatttgaaatatatgccattggctgggtgtggtggctcgcgactgtaatcccaacattttgagaggctaaggcaggaggattgcttgagcccgggagtttgagaccatctcgggcaatttagtgagaccctgtctctacaaaaaatacaaaatatacctgtgcgtggtggcatgcacctgtgggcccagctacacaggaggtggaggtgagaggatcaccggagcccagggaggtcgtggctgctgtgagccacgatcatgccactgcactccagcctggatgacagggcgagaccctgtctaaaaaaatatatatatggcatttttaaatctgtatatgcatataaacagatatgaatacacacagtcccacacacattttacattcaatataattggattcatactgtttgcaattttgtacaaaatcttcggcatcaccttataatctttgaatatatccatatcaatatatacttttgagtgcttgagtttttttatattttactctagaaaaactttaagaaattacaagcagaaaacatatggtaggtcaaacctagtgagaagtaatcacttttaaaatatctatgctatgtattatgatctctttcctatgcacatataatatgtacatttataaactaatgttcaaattcccctgtagtataatcattgaaacaagttttcttcactgataacttgagtacttttcaaatgtaattaattattcttggaaataatgataggtttaaaaatattggcactttttgaaactgtgttggtaaaattcatgtaacataaaaataaccattaaaatgttcaaatttggtggcatttagtacattcacaatgcagtgcaagcactacctctgtgtagtggcaaataattttcattaccacaaaagaaaaccgtgaactcattaagcagtcattccccattccactctctgcccagctcctagcaaacactaatctactttccctcactactgatcatcacaataagtagccttttttctttcttctttcacttagcatgttttcaaatttcatccatgttgtaatatatgtcagtacttcatttcattttgtagctgaataatatccatatgtatatatcacattttgtttatccattcatcaagtgatggatgtttgcttatgttcaccttttgggtattgttaataaatatatacagtgagtatataaaagtacttgtttgagtatttgttttcaatcatatgtggtgtatacataggagtagagttgctagctcatatggttccttctatgtttaaatttttgaagtactgataaactgctttctgtagcaggtgcacaatttagcatttccaccaacactctagaagagttctaacttctccacctctccactgatatttgttctttttaagtaattcccattctagtgggtgttaattggtaccatcaggtggttttgatttacgtttctgaaaagactaataatggaagcatctttcatagaactgttggctatttgtatatcttctttggagaattgtatatttaagagctttgcctatttttaaaatttgcatataattgtacatatttatgtagtacatatattttcatgcatccacaaaatgtgtgataaccaaaaaaggataactgggatactcatcacctaatgcatttattatttgtttgtgttggaaacatttcaaatgttcttttaggtatttggaaataagcattaaattattgctaactatggtcgccctaagtatgctattgaacactagaacttactccttctgtccaactgtatttttgtagccattaaccaacctctcttcattcccctcctttcctaacttctggtatccaccattctactctatagttccatgagatggattctttcagctcctgcacatgagtaaggacatgtgataatttgtctttctgcatctggcttatttcacttaacgtagtgtcctacagttccattcatgttgctgcagatgacaggattttattcctttttctggctcaataatcttcctttttatatgtatgtcacattttcttaatccattcatccgtcagtgaacacttaggttgattctatatctttgctattgtgaataatgatgcaataaacatggcaatgcatatatctctttgctgtactggtttcctttcttttgaatatatactcagcagcgggattgctgcatcatacggtaactctatttttagctttttggggaaactccatcctatgtcccatagtggctgtattaatatacatttacagcaacagtatacaagcattcctctttgcttcctagccagcaactgttattctctgtctttttagtaagagccatttgaactggggtaatatggtatctcacatggttttgatttgcgtttccctgacggttagtgatgtttaacgtattttcatatatctgttggccatttgtgtctttgtttcagaaatgcctattcagatcatttgcccatttgtaaatcagataatttggtttttggttattgagctgagtttgttttacattgtgatttgttattccattgttagatcaatagtttgctaagatattctctctttctgtaggttgtctcctcactttgttgttttctttgctgtgcagaagctttctagcttgatttactctcatttgtctattttcgctttgattgccagtgcttttcagatcttatacaaaaaatctttccccagaacaatgtcttaaagcatttccccaggctcttattctagtaatttcatattttcgggtcttttcttaaatttgtttagccttgttctgtggcctaacatatgctctatactggagaatgttccatatgctgatgacaagaatgtatattctatagcaattggatgaaatattttgtaaaggtcagttaagttcatttggtctagagaacagtttaatttcaatgtttctttgtctaattaagctgtccattactgaaagtggagtactgaagtctcccagtgttgttgtacgccattctatcactctgtttagatcttcaaatgtttgccttatatatttctgtgttccagtgttgggtacatacatatatacaattgttatatcctcttgctgtattggcattttcattgttatacagtgaccttctttgcctctctttacagtttttgacttttaatctattgtatctaagtatgacctttctctctctctctctctctctctttctttctttctctctctttctttctttttttttttttgagatggagtctcgctctgtggctcaggctggagtgcaatggcatgatctcggctcactgcaatctctgcctcctggattcaagggattctcctgcctcagcctcccaagtagctgggattacaggcgtgtgccaccacgcccagctaatttttgtatttttagtagagacagggtttcaccatgttggccaggctagtcttgaactcctgacctcaggtcatccgcctgccttggcctcccaaagtgctaggattacaggcgtgagccaccatgctgggccagagtatagcctttccggttcttttttcattcctgttcattttcatgttgctgctgatgccctctctgatttgaggtcttctttgtctcagcaaaagacgagtccccaaatttaatgcactggggttgctagcttcgactccactttttgtctctagctgccctcagagatttttcttcctacaggcagtcaggatgctttctagggagtgaggcaagaacagcattcctgcaaaggacaccaaaatggtagagaagctagctgcctgcctggatctcacattttacagaggaaaccgtgagtccagggggaattttctacatggtgcctagcagctttgagttggggaatcacagagacagaagtctattaatctttccagctgctcatatgtattcactttcttgtggacccacagatcgtcatagtctcaattttcagttctgcaatattgcttgtgacaatcttggcactagacagctatttttagttttctttggggtaaagtcagattgcttccactctaccattttggtgatgtcactctcccttggcctattttttaaaaattgggttgtcttttgttgtttttaagagtcctttatatgtattggatattagcagtttttagataattgatttggaaatatttcctcccactccgtaagttggcttttcaagttctgaattgtgcactttgatgcaaaattttttaattccagggaagtccaatttattttttcttttgttattggtgcttttggcggtatagctaaaaaatcattgccaaatctaaagttttgaagacttattcctatagtttccctgaaggttttatagctttagctcttacctttagacatttgatacatttcaagttaatttttgcacatgatgtgaggtagaggtctaacttcatccttttgcatgtggataaccagttgtctaagcactatttcttaaggagtctattcacgtctcattaaatgaacttgataactttgtgaaaagtcaattgaccacaatgtctgggtttattttcagactcttcatctcttccattaatcactgtgtgtattcttatttgatcatcagcctgctttgattactctagattttctagtaaattttgaaatctagaagtgtgtcttccaccttggtttttcttactcaaagtttggttactcagatctcttgcaatttaataggatctttagaatttgctctttctttttcccaaaaataaatgctcatgggaataataattaggattacattaaatctgtagatctctatggctagtattgccatattataaatatttagtcttctaactcattacccacaggatgtcctttttaaaaatccaggtaatctttaagttcttctccaatattttgtgatttttcaatgtacaagtctttcatctgtttagtgaaatattctccttaaaatatgatttattttgatgctattataaatggaattgctttcttaattcaattttcagattgttcattgctagtgtacacaactataactgatttttacgatttaatgttctatcctgtggggcttgctgaatattgttcattagctctaatatggtttttctgcagtttaaagcatttttataatatcatcatctttatgaagagagataatttccattttttttttcttttttttcttttcaacttggatgccttttatatatcttcattgtctgatgaccctgactagaattttaagtgtacaagaaaagggcaaaagtgtgcattcttgccttgttcatgatcttgggaggaaagctttcagtctttcactcttgagtataatactacctgtagattttttataaatgccccatatatcgtgttgagaaaatgatcttctaatgatagattcttgattgttttgagttgcctttccagagagagggactacagaagttccctaatgcatacttttcattgatgtcactttcgccacctgtttttgaattcgtagaaacaatcatgcttcttgaaaacatacctgccacaatagtcatacatgataacgtgaagtgagatcacgggtaatgccatctccaacaaatactattaaaatgtagattgattttcagtccctttcactgtttttggtttatgtgtttatgtacaacagtccactagaagaagatgtaactcttccttgattagctcagtggttcaatttctctttatgcccttctagtcttcagacaattgggtgcccttgagaccctcagaaaacttacttgctcctgctacatcccacctggaattggtctgtccttggtgttctcacattgctgcaacaaatgactcatgcctcacagcagagtgacactgcctgaaagcctgctaactcttgctccaagggagaaacataacgcacccatccattccccacgtaggcaccgtgtaaagtctcaggaaatacttgaagtatatgtaacacatgggaatgttgttattttggtgttaaatgatgcgaccatgagatataactctgtgtaacctcgacaggaattgaacatatgcattatgagtatcattccatgtggagtatatgtggcgggcagcaatgacaactatcggatccctcctctatggctgatgccaaattactgcctatagtgcaacacatgaggctagaacatgaagaactccctggttgtctgggcggggagccagatcaaagaacaccagaatttgtaaattgcttgccagagaagatctccaagtttcaagtaattttctccttgtgccttcatcccctgaaaaagataattttataccatgaagtgtactggccccttaactctgtgaaataaatcgcaccctcaaagtcttggacaggaggatatttaatttctgaaagcacaagattcttaatgaaggcgggccttgtttgatttcaagtggaaaacaaaagcaaaagtgcagcggtaagaccagctggccccaaactgggctaaatgcaaggcagccatgtttggtggcgcctttgtggatgcgtggcgttttttcatacaggaagggcgggagtagagggcgccaagaccagactacttagcatatttggagcactactgccatcgtgaggatgtcgtttaacgaaaccctacgccattacagagttctagtgtgggctacctgttgggacaggtctggtctggtaagaggtggaagaggcttggcctctatgctgggaggcctcgcctactcctctaaggctttaaaaaagacctggacattggcggtatcttgctatagaacctggagtgtgaaggttctaatagcaaatcctgtaaacttcccttggaataaccctgttaattgtgcgcaacactcatgctaccagagacccaaagatccatagcaagatgacagctcgtggaaaacttctgactcttgctccaaggggcaggaacagcaaagagatgcccataagagcctacatgtgtctttgagagggtttctgctgtcctgcccacaccaggaggaactgaggccccgacccacgacttcctgtaccaggacctcctggcagctgctgcttcactccaagcccctcaatctccaggttctacaccaagataccgccaaattccagttctctcttcaggccttagaggagaaggcaacaagacctagtctggagcccaatcctcttccacctcctcacagaccagactttcccccacagcgaggcttcccgggaaggacgctgtaatagcctattctgtctttaaacgatttcctcacggtggcagtagtgcttcagattttcaaggacgccctgtcttggagcagtcttctcccgcccttcctgtctgaaaaaacgccacccagagacaaatgcgccaggagacatggctgccttgcattttgcacagtttggggcaacctgtgcaaattcctgtacttttgcttttcttttccatgtgaaatcaagtcaaagcctaaacgacccatcctcatcaggaatcttgttctttcaagaaattaaatgttttccagacttagtctatgtgggttggctcagtactttcacatggtatcaaaatgtctgtctcaggccggaaattagaccgatcagagaagaaaagcgataataaatggtcagaagcctggagatcatcatgagccaccaattcacaagtctaggtgatctttgacctattcccctccccagacaaccagggagtcctcctccattttctcagtttatgtgatgaattgtcagaaagtgtttggtagaagtaggaagagaaggccaagacagcgcacatcattgtatgtaatacattgttccacagggcatgatacatatacttacatctgtataaactcccattagaagttacacagttttggggcagatgcagtggctcacgcctgtaatcccaacactttgggaggccgaggccggtggatcacttgagatcaggagtttgagaccagcccggccaacatggtgaaaccctgtctctactaaaaatacaaagatgagccaggtgtggtggcccatacctgtagtcccagctactcaggaggctgaggcaggagaatcgcttgaatccgggaggtggaggttgcagtgagctgagatcacgccactgcactccagcctgggcgacagaatgagtgagactctgtctcaaaaaaaaaaaaaaaaaaaaaagatagttacacagttttaaaaattgtcctctgtttaacagtgaataatttatatttccacatgttcctatgccattaaatatttttcagcttcttcttgtgacttgagtgtgtgtgtgtgtgtgtgcctgcatgtgtgtgtgtgtgtgttacctcttatctcttaggtatcagtcttacaatatcttcttattagcaatggtgtttgcaagccaggtacagtcttgtgttcttgtagtttcagcttcttggaaggctgaggcaggagaatagcttgggcccaggagcagagcagcttgaagaacatactgacaccttagtctctaaaaaaaaaaaattaaaaaagaatgatgtttgccatatagttcaaaaataatcttgtgtacatcaagaagaataacaccatcataaaatctgttaagacaactgataacattttgggttattttcttccatacttttcaatgtatagatacatacgcctactatattttgttcacacaaaaaataaatctatattaaaattggattaatctgtacattgtggtttggatcagaccagatgtgtattctgacaaagttttgaagggaaagtatttgcttgcattaaatgcatgtacaaattctccttaacatcttgttttgtataaataagtacatacacacatacatacggatataggcacagatcatggtaactgaaatgattaccatgactaatcactaccatgactaatcactactatggttagtaaacatgtgtacacagataggtgtataaatatcataaataagtggtctctcaatcccaataggaaatgacttttaaaatggttttatcacacattcacgtcttctattggtcatataagaacttctctatttaaagttcccatatatttgtatgtccagtgttcaaatatgttctctacatttattgtagcttaaacatttgcaaacttgttaaatattcttaaagattattcttaaatattttgtgggatgccaggttgtttttaagagtgccttcctgtttttggcatttctcgaaattagatctgcttatttacaatattttcagatacagtagccctgtttaaagaaaagcaggtaggtcacagttaatgccaccaccaagaaacaagtaatttcaaaatgcggatctattatcagcattccctttctctttctttctttcttttcttttcttttctttttttttttttggcagtttctcgactttattagcctggagctcctctccgacatccccaggggctggtctctggtccctgggcacagtgagcaggactgaggtcagacgggttcagcccctggccatagcagcttgggacagctgggccaagggaacaacaggtgcaaaagtccaaatgctggcacttcaggtgtggccggcacccagccaggcgcaacagtggatgggcaggacgccatgctcctctcctggcgataggtagaccatagcagcgctccctcccagcagccgctaggaacagctggtgattctagccaggaagtgctgcgcccaccactcgtccaagtcaatgggcacgaagttctgcagccggggattggggatcctctccactgcacaggccttgtcccgccctcaccggctgggccaccatccagctgctgccgcacctgctgccaggcttcggacacaaagcggacattctccttgtgggccagtgtgtaggtctcctgggtcccctggagggatggggacttggaggggtcccgccggcgattcacacgattgaacacaagccttggccctgcactcgacaggggccagggtcccagcggctgcgcgaagggctgcgcccgctggggctgcaaggtcggcggcgcgggctgccggcttttcaggagctcctggagctggcccttcacctgctgctgcgtgagacctgtgcggcgctgcgcgaccaacttgctgggcccgttgatgatggtgtacatggcgcgccgctcccagactgccgccggccccccaccagatctcagtattccgtttttctatgtttcgaagaaatataaattactgaattccatctgtggtcaataaggattttgcaccaactgtttcagtacacgtttgttcttgattgcttctcaaattatgaatatcagctttttgagaaatctcttagaatattcaaatctgtgaaggacaagcaaaaacacttcatcgtaaatcccattttcatgaagcaaccaccatcagcagcttgatggctacatgcattcaaatattataaatggattctatgattgttcatgagaggtgatactatttaactaaagcgatagaggcttattaatatactcccttatttgcacaacaaagtgttcaacatacacacacaatcacattaattactcccttcaattccatcctcatcaaactataggtagtatttaatgccttgaatatttcacacaatattaggtaatgggaaatttccaatggcatggagtaactaatagtactttattgctaactctcataacatttctttattgttcaaaaataacaatgaatcaactagtgctcaaatcctaaggatgatataaacacttagcaaaaaaatgaaaaattgaacaattatagcagaagttaatgagacatattctctatcacataaactcaatcaaaattcaattactgtttttctcaactgcatttagctcgttcttctatttgcattttattggggggggtagagggaatgtacatgtgcaggaatttttttttgttataaacatcaaataacaccctttatgtgaaatttccttctaatttaatatttttccttctatcatttttctcaggttttatatagaaagcctacttaaaatgtcactaaacatacttcagctaattggattttgtgttaaataataatttgttagaactttttaattttcttgactagtaagagcaagacatttaatcatcccagcatgtaaacagtgctgtttatttttaaataaaaacatggtattactcagaatgttatcagtactaagccttatttgtcaatgtgtcaagccttcattataaataaaagtaaaactggaaaatgtgctctcaaaaactcagctttagagaagtagacactgttagttgttttgtttgaattttttcaatttacagatacattacaatgtgcatattggctttctagaatacatacatgtttagacgtttggttcaaggttatcacatgttagaagtaaaatgcccttgactttgccatttctcttacctagtgttagcaaacttacatggtttgatccccaaggtccaactgtttgcttttctccctaaatcagaggcagggaatgtctctgccaatcaggccacagagaatggaattcagactttgtgaaggctgaagggattacctaaggagcctaactcatctagtcaaggctttctgtgagtgttctttagatgatatttgaagggaaggttagaggtcatttttctctttcacaaaatacctggaagacctcgtgctttgcttcccagagcctctgcaaggcactgctgtgtgtcagtacacctatgtccataggccatccttgaaatcaaccatgataagtcaaaaagagagaggcacaggccaggatgtcacaaaagccagttcccttctcctggtacagcatggtctacatggtaggtgatggaatcttacctttcaaggtaagatatatttttatatcttttaggtctagttgactcataactttgttcacatcctctaattccttaatgatcttcagtttagttgtttcattcattacttaaggtggggtattgggctgggtgacgtggctcacgcctgtaatcctagcactttgggaggctgaggcgggcagaccactcaaggccaagagttcaagaccagcatggccaaaatggtgaaaccccttctctgcgaaaaataaacaaattagctgggcacattggcgcacgcttgtaatcccagctactcgggaggctgagacataggtattgcttgaacccaggaggcggagattgcagccaagatggtgccactacactccagcctgggtgacagagtgagagactctgtctctaaataaataaataaataaatacataaagtggggtattgaagtcactaacttactttttagaactctattttttcctttagttctgttcagtttttgcctcatgtatttggggactcttgtaaaataaatatgtatgtttaattagtacatcttgacagactgaccttatcattatataatgtccatctttgtctcttgaaacaattattgtcttaaggtatattttgtctggtatcagtacagtcagaccaattttcttttggttactttttacatgaaatatttttttcatgctattactgttaaccatttgtgaattggatctaaagccaactcttttagacagctagagttggatgttctaaaaaatccattctgccaatctttgccttggagtttaatccatttaaagtaattactggtaaagagggacttattcctgctattttgttatgtattttctgtatgtcttatagcttttttctcaattccataattcctaccttcttttgtgattaattgatcttttctagtgcaccatttttattcctttctatttctttttctctatatactaatttttttctttatgttatcctgcagaatacaattaatatcttaattttagagtaatcaatttttattaaactacaaagtagtttatatagtacataaaacctactcctttaaagctctaatcccttttgtgttatttttacaaacgacatcattaaacattgtgtacctattaatgcagacttataattattgtttcattcatttgtttttaaaatcatatgggaaggaaagggaattataaaccaaaaatataattcttctggcttttttatgtatctatgtagctacccttttctttgttccttatttcttcatatggttttgagttactatctagcgtattttcatttcatcctgagagactcctttttgcatttctgttatgggaggtctattactggtggaatctgtaagtttttttctatctaggaatgtcttaatttctccttcatttctgaaagttagtcttgggggatatggaattattgacaagtttgtttgctttagaacttcaaatatgttatcccactgccttttggcttccatggtttctgaagaaaaactggctgctaatcttattgaggagtccttgtatataattaagccctttctcttatgatgctttcaagattcttgctttgtctttgtcttatgacagcaggattataagctttctcattgtagatttcttcgggtttatcttacatagagtttgttgagcttcttgcatgtttatattcatgtgtttcaattgctctagcttcacattcactgacttttttctaactgttctaatctgctgttggaaacttccagtgatcttttttttttcatttcagtttctgtacttttcagttccaaaagttatatttgtttttttaaaaaataatttctctctctttattgatgttctctacttggtgagacattattctcttggtttcttttagttctttgtgtttcatttatggtaacactttgagcatatttaagagagttgacataactcttttctagtaagcccaatgcctgggcttccttctgcacagtttctatgaatttctcttttccctgtgagtaggccataccttcttgttttctttgcatgtcttatgttttgtttatcattaaaaattaaatgttttgggccgggtgcggtggctcacgcctgtaatcccagcactttgggaggccaaggtgggcggatcacgaggtcaggagatcaagaccatcctggccaacatggtgaaacccgtctctactaaaaatacaaaaattagctgggtgtggtggcgcgtgcctgtagtctcggctactcgggaggctgaggcaggagaatgacttgaacccaggaggcagaggttgcagtgacccgagaccacgccactgcactccagcctggtgacagagcaagactccatctcaataaataaataaataaataaataaaaataaaaattagatgttttgatatcatactgtatcaactctggaaattagatttctaaacacacttgcctccccaccccatggggttagttgatagcagttgtgtgttgttgtttgttatttgcttttttagtaacttttcttaaatatttttgtaaagtctgtatttttatcatttgtagccactggagtcagtgttctgatagcttagtggtcacctagtactctgacagtttccttaaacacgtggagcctaagaaagaaagaaaagtagctgggtgcggtggctcatgcctgtaatcccagcactttgggaggctgaggcaggtggatcacctgaggtcaggagttcgaggctagcctggtcaacatggtgaaaccctgtctctactaaaaatacaaaaattagctaggcatggtggcgcaagcctgtaatcccagctactctggaggctgaggcaggagaatcgcttgaacccgggaggcggaggttcagtgagccgagatcgtgccattgtactccagcctgggctacaagagcgaaactccgtctcaaaaaaaaaaaaagaaagaaagaaagaaagaaagaaagaaagaaagataagtattctctaagtccttgaaaactggctctgtgtgttggggcactctttcaactagccaggctgtagtcttcacttctagcttgcaaggggcctgaaagctagtgagatctgagaccttaagctcttctcaggcattttctgcataattgtccagccctgcccatgtgcatggctttcttatttctctagtgtatacaagaacattttaaagttcttattcccccaagtatttcctttcatagcctcttccttcccatgcttttccatctgcttattgtttattttaactgttgtcccttgcctcagattcttatagccagtacttgtgtctttaagttttttcaacacatgcccctcaggagttgttccaaacttggaaacactccaagtgaggcaaaacaaaaagcaagctcttacaccaatcctttagggagccaaaagacagatcaaactggaatgcaacaattctttgagaataagttctgtattatacctatgcacgagggtaggagctatactgaaggcactgtggaggctgggggatggtagacaggtaatttaaaatgccgcagctctcttgctctctcaccacaaagcagtcacttatttcttcaccaaggcttccctgggtgttgtaagtttttgacaagctctagagttctgtaaaagtggattctgacacttctttctttctttctttctttttttgagacggagtctcgctctgtcgcccaggctggagtgcagtggagcgatctcggctcactgcaagctccgcctcccaggttcacgccattctcctgtctcagcctcccgagtacctgggagtacaggcgcccgccaccaggcccagctaattttttgtatttttagtagagacagggtttcaccgtgttagccaggatggtctcgatctcctgacctcgtgatccacccgcctcggcctcccaaagtgctgggattacaggcgtgagccacggcgcggggccgacacttctttctagttcatgcctggctcttgctgcttttgtggagggatgatgtgccaacgtgtcctccttcatgatcttcagtgacatcatttttgccacctgatttttgcacttctagaaataatcacatttctttgcaatgttccttctacaacaggcatgtatgaagtcatagagtgatatcacaaggaatgacacctctggcaggcaaggacttggaaatatgtgttcattttcaatccttttcactgtctgtgttgaaatagcttagtcatatgtaaaacatctaaattagattgaattatacttcagtttttgtttatgcttggctaacatatttggattacttcttctccatctgttttttcatatctactcctttagacgtttcattacttcttggtttgactacgtggccccacttctcctcaattcctcctggctgcaggcagtgaatctagatgtttgacctgagatcttcagcaagcacacttgcctctgcaatgtcatctggaattggcctgttctttgtgttctgacacagctgccacaagaaaccaacgtcccatagcttctttgaggagtccttgtatataataaggccttcatcataggatggtggtaccacgtgaaagcctgctaactcttgctccaaggggcaggaataggagacagatgcccaaagagcttgcatttgtgtttgagtgggtccctcaagtcctgaccacaccaggaggaagtgaggccccgccccacgacttctgtgccagtaccgcctggcagctgatggttcactccaagcccctcactctccaggttttataccaagataccaccaatgtccaggtctctctgttaaggccttagaggagaaggcaaggaggctcagcatgaagccccagcctcttccacctacccacagaccagaccttccccaacagctgggcctcaagggaagaacgctgtaatggcgtattctgtctttaaatgatttcctcacaggggcagtagtgctgcatattttcaaggaaacctgccttggggcactcttctcccgcccttcctgtgtgaaaaaacgccactcagagataaaggcgccaccaaacatggctgccttgcattttgcccagtttggggcgacctgctcatactgctggaattttgcctttgtttccatcttaaatcaaaccagggcctaaactacccactttccccccccaccccccactaaacactcaataactttatttgcctttggttggctcctgggtttggggcggggtaggggttggcagcagcccgggcttcgtgcgccctctggtggacctcagaggcaagaactggaatcccggccaaacctgaggacttcacagtcaatagtttaggagagttgcatggttcctcaggtctgcagtccagacccaacaacagtggacggggcacgttgggaggaggccctgaacctctggctctcatactcgccagtgttggacacccgcatgttctgccgagccctcatctgtttcacacggtccttgtccacttcctgcttggtgaggatgaagagaaggataccacaagggaagccgatggcccaggccagtcccacagctttcatggggttcttgcccctctttctgggaatgtattacatctcgggggataggagttcaggttcctccctgccttcttgggagctgtgggtttgcagtgcctgggtcctgttatgggaagccttgttagctgtggctcctgcgagaatcccccggaggacgcgggcatttcttgccctccatccccccggcccttcagcgccttagcagctaccaccaccgccatgttcagatcccaccctaaaccacccacttttatcaggcaatattatctttcaagaactcaatttccacttaacctagtctttgcagttctgctcttaactcagttttacatctcaagcattttccctacatgatcaaattgtttacgtctaggggcaagtctcaaggagctaggcctaggaggaagacgacaattttgaaaaattaagggcaggattggggcatttctaggcagcaggccacatgttccttaacttggcttgctattgttaaagagaaaattattccagcacctgttaaagtgataaggaagactattcaagactactgcaatagggacattgcaataggtgagaaatagatcagtctccattctgagcatagcaaagacagctggagatttatagtcaaggagcagagtgaggggggtcagtgcatggaacatcacagagaggagacatcaagggtaggggaattcttgccaaactgagttaagattcttattaaaactggactaggcaagccaaagacaggactcaagaatgagctgttaaaaagagggctcagaggagcctatctacaatttggtcaaggagatagcctttgtcaatattcatgccctcaaggagtctttctccatttacggggttagactctgtaaaatgagaggcaactgtttgcttggagccctaagaggaaggcttagataccgctcatcacttcatgccataaatgcccactttgagtagtatacatatataaatacgtataaacccctatcagaagttactaaaaggttgtctcatgatttcatcttttaacctgggaacacaagcactttctcatatcattaatttatttcactttatttttgtttgttgtcattgtatttcttctcatttgaaattagttacttagtttcctcagaaagttaaggaaaatattcattgaaataaatgacaaatattactgaacagcttagtcatatttcaacttgttaaatagatttaggagtaattcagtttttgtttatggttggctataatatttggaccatttctcctccatatctctccaatggaaacaaaatatataggacgaaatacaaaattctccttaaaagtgtcaaagaattcacaaaagagaaagtctcagattaaaactctaatagagagaattaacgggaacaccagattacccagtctttttggccttttgggtatttgcttacctgggtagtattggccttcattttcagggacctcacaggtggcaaagagcagaagatagaaaaagcctgaagggaagtataacgattaaaaaataaaacacacttagggattttcctttaacacaagcacttatcccacatggttacaggttggttctatgaattctttttcttttttttaagatggagtttcactctttgtgcccaggctggagtgcaatggtgcgatcccggctcactgcaacctccacctcctgggttcaagtgattctcctgcctcagcctcccaagtagctggattacaggtgcatgccaccatgcctagctaatttttgtgtttttagtagagatggggtttcgccatgttggccaggctggtctcgaactcctgacttcaggtgatccgcccgcctgggcctcccaaagtgctgggattacaggcaggagccaccatgccgtccggttttataaatttttaagcaaaagatgattccaatcttattcaaaatattttagaggggaaatagagatgaattacttcccaacatattctgagcaacttttataacattggtacctaaatcaaacatagattgtgactgaagagaaaaatacaaactcacttcaattataagtgaagacttaaaaattgaaagatatgagcatatttaatccatagttctgtaaaagacaataaactatgatcaacttggatttatctcatgactgaaagggagttaaaacagtgcaaaaggactaaatgtcatacaccacttttccaaataaaggagaaaagtatatggtcatctcgatgcagaaaaataaaaatatttggtaaattcaacagcacttacaatataaacttttaggaagccacgaatataaaggaacttccataatctggttattatatcatttaatcattgctctgtgaaaaactattttttaactcagtggcttaaaaaacaagcacttatcataactaaaaaatctacaagtaaggccaagtgcggtggctcacgcctgtaattccagcactttgggaggctgaggtaggcagatcacctgaggtcaggagttcgagacagcctggccaacgtggtgaaaccctgtcactactaaaattacaaaaattagctgggcgtggtggcatgctcctgtagtcccagctactcgggaggctgaggcaggagatttgcttgaaactgggaagcacagattgcagtgagccaagatcatgccactgcactccagcctgggcgacagagcaacactctgtctcaaaaaaaaaaaaaaaaaaaaaaagaatctacaaatatactgtgttgttgttatcatggtcttgcctggattgtcaagcatctggcatcagcactgggtcaggttggcagctctgctaatgctatctcttacatgtttgggggtaaattcactgtagagactgctggtctctcctccccatcctgcaacaggccagcctgagcatattcatacactggtagcaggtttgcaaggaaaagtggaagcacacaagtcttgtgagactcagagctgacacaccatgacttcagaattttattaactaaatcaagtcacaaagacagcccagattcaagaaatagggaaaaagagtccacctttttcctggaaaaggaactgaaaattcacattcaccctaggaggagaatttaggacgttttcatgttcaatttagtagagatatctacaaaaacctacatctaacataatgcttaatgggaaaatagctaaagaattcctttcacagccatgaataatagaaggctactcaattatagcaattctaccaaaaagagtcctgaaggcaatgaaaaaagaaaaatgaaatgaaaacaggattagaaaagaagaaaagtaaaatgtgatatatattgtataattttatacatgtgtaaaataagagaatacatcaaactgggcataagatcaatatataaaagtaaactgtatttctatatagcaaagggcattagaaaacataaatttaaagaagacaccatgtgcaatagcatcaataactataaacgaactagggataggccgggctcggtggctcacgcctgtaatcccagcactttgagaggccgaggtgggtggatgacctgaggtcaggagttcgagatcagcctggtcaacatggggaaaccctgtctctactaaaaatacaaaaaaattggccaggtgtggtggcaggcatctgttatcccagttacttgggaggctgaggcaagagaatcacttgaatccgggaggcggaggttgcagtgagctgagatcgcgccattgcactggggcaacaagaatgaaactccgtctcaaaaaaacaaacaaaaataaattaactaggaataaaagatgtgtaagacttttcatttgaaaatcatataaaattgctaagtaggccgggcacagtcgctcattcctgtaatcccagcactttgggaggactaggcaggcagatcacctgaggtcgggagttcgagactagcctgaccaacatggagaaaccccatctctactaaaaatacaaaattagccaggcgtggtggcacatgcctgtaatcccatctactcgggaggctgaggcaggagaatcgcttgaacccgggaggtggaggttgcggtgagccgagatcatggcattgcactctagcctgggcaacaagagcgaaaccctgtctcaaaaaaaaaaaaattactaagtaatagtaaagaagattgaaataaatgcagacaccatgatcaaacataggaaaatgcagtatcataaaggtatcagttctatgacaattgatttattggttcagtactactctatttatcattgcaaaatgtccgtctttttatgttttagtgcttttcacttcaaaagcgcatttctctgatattaatattggtactgctactttcctttggtatgatatttatttgccccaaccttaattttcaaaacttcctataattcttggctttaagtgacttaatttttaaaagcactgtatagggttgtttttgttattgttttgcgttttgtattttagcccaatataatgacttctgtcttttgaggagataattgtgtccactcacgtttactgtaatgaagaaaacacttaactttattcctgccttcctacattatgtttattacttttttttccacttcatttctgatgtttgagttgttgattatatctttttaccaattgttaatttccattaatagttaccttcatttctccatgtctaccaatagccacatatttttctaatgttgcccgaaacaaagtactataaagtcccccaaagcacactatttcttagctcaaggtacctaatattcttcctcaaaactaacccaagatgttgtgtccattaaaatatgtattccaattcgtccttttatattttccccacttaaaagatttgttaaaattctttaatatttttattctgtactcatgttatgtcctttgcagtatagtccctcaattatgactatttagagtgcttatgtcttccatttatgaagagtgtaaggtctttattcctgtttctccttcttcatccacttcagttctcttttctggaatattcatttggctagatttcttttttttctttttttttgaggcagaatgttgttctgtcacctgggctggagtgcaatggcgagatctcggctcactgccacctctgccttccagtttcaagcgattctcctgcctcagcctcccgagtagctgggattacaggcgcccaccaccatgccaggctaatttttgtagttttagtagagacggggtttcaccatgttggccaggctgctctcgaactcctgacctcaggtggcccacctgcctcagcctcccaaagtgctgggattacaggcgtgagccaccgcgcccggccatggctagatatttattcaagtattatccttatacaggatatgtggatgatatattatctgaaggtttccatatgcacaaggaacttctgttcagcctgactgatgaataatttcttggctggagacacacaacggttatgttgtattctctctctcctaatagtctatagatgttattccattgatacttgtttgccagtgttgcagagaagtcagaatggagtctcattccaatatttcttttgtaagttttaatttttacctgggaagattataaggtgactttttaataattctagtattttaccaacatatgcttagtgcatatctttattccgttctataccacagtgagactctacaatctgggccttcttcaattgtgggaagttttcttctacttgttgccttaaattttgccttgtttattctgttttttccctattgtaacatcttttagtaatatgttaaaaccttagatctttaaggttattaacttttccttatttttcccattgctttattttttcctttgttttgagatatgttatgcagttgatccttctagcctgtcattcaatgtcagttgatctccctttcaaaacttttcctaatggtttagcattttcctaaataaaggcttttgggaggcatctgaatcttaataatttcatatttgttttttaattcaagttgtcatttttctcatctagctactgtatttgctgattcaaaggttggcttgttcagaggctgttaggggcctaaggctgcttatgcctcttaagtgggctacaatttattttgttggagttattaagtaacaagtagctgaaattccacaagtggtagagtataaagtgttctttactcctgtcagctactggaataccaccatcaaggacaatagctaacaaatatcgaacacttaaccacataccagggaatattctaaggatctgaatacaaattcatatatttattctttacaacatccttctaatgtaagtagtatgattctagccacttacttaacgaggacagatagcaaataaagttttttttgtatttgtttttttttgttttgttttgttttgtttttttgcgacacagtcttgatctgttgcccaggctggagtgcagtggtgtggtctctgctcactgcaacctccgcctcctgggttcaagcgattctccttgggttcaagcgattctccttccttagcctcctgagtagctgaggttacaggcaactgccaccatgcccagctaattttcttttgtgtttttagtagagacggagtttcaccttgttggtcaggctggtctcgaactcctgactttgtgatccgcccgcctcagcctcccaaagcgctgggattacaggcatgagccatcgtgcccagctgcaaagaaagtttaaataccttatgcaaagtcacagaagaatagttagaaacaaattttaaaatcggattagtcaggcttcagaattcacattcttaagatctagattaggcaaactgtcagctcacttccaaggcactttgaggaagcctcccaacttttattggttttcttgcattctccaagtctcaggtccagggaggactcaggtaacaaattcagttctatcttgtattcttggcataggggaacaactggcaaaaataagtccgactcagttgaccttccaattattagtccacctgtttatcaggccaagccctttccacaatctgttccttttcattgcaagctttaaaaattctggccaggtgtggtggctcgcgcctgtaatcccagcactttgggagggtgaggcgggaggatcacgaggtcaagagatcaagaccatcctgccaatgtggtgaaaccccttctctactaaaacaaatacaaaaattagctgggcttggtggcatgcgcctgtagtcccagctactcaggaggctgaggcagaagaattgcttgaacccaggaggcagaggttgcagtgagctgagatagcgtcactgcactccagcctggcgagcagctcaagggagaaattcccataaagaccccacttatccctagctacctataggcccaaggacccctttggctcagaaaaaaaaagataaattagagttgggaatgtagaaatatacagtcacattcaggttctaatgttttaatttttaaaaatgccgacgttgtttaactatatttatgggtatatgggtattcgttaaggctgtttgccaaatatttcaattactcctcctagatactgttaagatagtggtatttggctaagggatggagtcaaaaccatagatctgattaaataaatacctaacctactcctgaaatcctgccagaatcctttataggagaacataaccaggacatagagcaaaacagccagattacatagtccatacagattagccatttgatacacagagaagtagagaaaaatgaagagtggattaaagaggagaaaatagaaatatcagggaaaaaaatccaacatacgctattatgcaattggtgtttaaagaaaaaatacatacagattatagtaatacgataggtcattttgtgttcacttatctgaattccatattttctaaatattctgtattgagtctattacttttaattttaaatatttctacttataaatatttatataaataaaaatatttctatttcttataaataaatagctattttcatatttttaaattatacttttggataactaaagtacaactgtcaaaatgctcatactataaccaagagaaaaagtataaaagaaaaaatatgcaggacaatgcccaatttttgtaaacatgtatgtgtatatacaaattaaaatttatcggccaggcgcactggctcacacctgtactcccagcactttgggaggccaaggcgggccaatcacctgaggtcaggagttcgagatcagcctggccagcatggcgaaactccgtctctactaaaaatataaaaattagctggtcacggtggcacacgcctgtaatcccagctacttgggaggctgaggcaggagaatcacttgaacccaggaagcaagaggttgcagtgagccgaaattgcgtcactgctctctagcctgggtggcagagcaaggctctgtctcaaaaatagaaaaaaaaggccgggcacggtggctcatgcctgtaatcccagcactttgggaggccgagacgggcagatcatctaaggtcgggagtttgagaccagcctgaccaacatggggaaaccccatctctactaaaaaaaaatacgaaattagccgagtgtggtggcacatgcctgtaatcccagctactagggaggctgaggcaggagaatcgcttgaacctgggaggcggaggttgcggtgagctgagattgtgccattgcactccagcctgggcaacaagagcgaaactccatctcaaaaaaaaaaaattatcaatatatttaggtaaataaagcataaagatgtgatcagtgtttgtctcaagactgtggaatgataaatagggtgaacattcctttcagtgtgccttaggaagtcacggttcacacagttgtccaacttggacaataaattatacaattatctaaggaggatacacaatgtacattctctacctaactgcccaattaattatttaaaatgtgttgtttctttattcattcaaagcatcgtgtatgtgaaaattaaaacatgaatatatgaggcataaaaatataaaagtgtaagaaaaggtcatacgataaagttgataatgttttaacatattagttcaaaacctatggaacagcttaactctgatgtctttaaatgataatagctaaatatgagtatttattttgaacatcaagtttgagcaactgaaatatttattagtgagttctccatctggaaagacatttaaaaagaaggatgccattttggttactttctaaaatatgtgagccagaaaatggagtacgccataagagcctgggaaatgagccaggtcaaagaccacaacgtctgatggagacagatagccaagcctcatacaagctttggagttccagcaatatcttttcctcatgcacggactccttgggacttgaaccttgtatcagaaaacttgaaaatggggaaaatcctgcatatctaatggtgaccgatgaggagatctatgaagctgtagtagaggaaactgaattactgaaaagaaaagatgcctaatgagagtgggtggttttaggcttcagtttgattgtatatggaaagcaaaagcaaaagcgcagcggtgtgagcaagtttcttcaaactgggcaagacacaaggtagccatatttcctggtggctttgcctgttagtggtggtttttttcagatggaatgggagggagaagaaggcctgggggcagggttagttggcttttctgggcccatactgccatcgcgaggaagtagtttgacaaaagcaaaagcttcgggtttgaacttccctcctatctagcagttaagaaagatgtagcaaattcaaaggttcaacagggcctgaccccaagatgggccttctcaacttcaactcttaggctttccaggagttcagtctggacaaaggcaaaatctcagtgaagaagctgctaagtaaggtaccaggactgatgcagggctttggtttcctctcactgtgggcaggactatggaaaaactacagtctacacacagcttctgggcattggtctcctgaccctgccccttagaccatgagacatttgggctggcacaagatatccctgtactttggggtatgggccccaatgttagcaacgttagaatgtgaggagggggaaatgaatctcattcgaggtggcatctaacagcagctggaggtctcagggacaccaaaagtctggtgcctctgttgcctagagcaagaaggatctgaggaaaaggagcatgtgtcactgtgccaagtcaataaattccagaacatcaataagagtgcagatatacacaaccagaaggcctggaggtattctctgagcccaggagttaacagctgtagtggctttgcagcatttttttctagggtccattgtgaaggcatacccacgtggagggatctgctctcatttcatctctcttaatgggacagaaatggtttctttagctttcttctaaggaagatgaggcttttaaggctcaggatctaactgttcattaagattagcaagtattgttctctgtgcctgctccttagcctttttctgatgaagattccttgtaggcctgacaagatatccttcagggagttgagtacatcaggacccccagaaaacttgcctctttagtaccactctttcgtaccagggatgatctctgtacatgatcctttagagaaaatgctgagcagtccatgaaaacaagcatgagtattttgatattctttcttctgctctcttctaaatctattccatttgaatatttgcatgagtacgtgtatgtgtgacactcatgggtttgttggtatgactttaggcttccccatagtttgcagatctccttgggttttgaaatttttccttttccttttcccttttattataaggccaccgcatgggtcattaaatatccttcggatggttggattttgtgttacttataaatttgcccaaagatttttgttttcttcaccataaaaagtgattttttaaaatttccatatgtaaacagagcaatgtataattttcagagaaactgattcttacactgaaggctattttaaaacctgaaaggtatacctttgtttcttgatttccaatgtaaactttgcttgttactatttcaaacgtggagacatgtataacgttaatacttgagggcatggccttaaaataattactccaggaaggtagacacaatgagtatcttcgttagaagactgcaaattcattctttagaattcatatatatgcactcaacttacagtagtcatacatggaataagtagagagagatagactttattttttcctttgttttctctttttttttttttttttttttgagacggagtcttgctttgtcgcccaggctggagtgcagcggcgggatctcgactcactgcaagctccgccttccaggttcacgccattcttctgcctcagcctcccgagtagctgggactacaggcacccgccaccatgcacagctaattttttgtatttttagtagagacggggtttcaccatgttagccaggatagtctcggtctcctgaactcgtgatctgcctgcctcagcctcccaaagtgctgggattacaggtgtgagccaccgcacttggcttgttttcttgtattagtaaactaggatggtttgatcccaaagagtcaataatttgctttaacccctaatcaaagaggtggaatatctttactgatgtggacactgagaatggaattcagtcttttcaaggacttaagaggactacctggtatagctgaaacatgtggagtcaatctactagagaataggccctttgctcctccccactctctgacattgcagaggaaagctgaatgaacctactcatctctgcactcctgtctcctatgggaatgtgaccttgactctggacaaagagtgtgctcatgtgaaaggttaagtgatgcacacatattgcccaccaaatagttaaaccaattgacaatgcttcccacctcacgggaacttgtccaattctacaaatgttcacacaaactaggtgttatcagtggtttcatgttcagtaacttacttagggatattttgaagaggtggggaatggttgagactttgtcatactgtaatttacttgagtattggtgaatttgagaacctctgccaatggactttgttgttccatggcctttttcttctgcgaagtttgtgcctggttccttttctctttccttgctgaattgtttctctttaacttttcatcttggaatagctaatgatctgtaatggatgtcaatggttgaagggcagtaaatactgacaaacaattgcttgtagtttcctgtttttgctgttatttttattatgcctgaaacaatgaaattgtttccatcggcaatcaggcctgttagcctctattaagtatagccaggtgaggtgagcacaacattcttgagcctgaggaattcctgagctgaggccactgctagtgccatccacagttctgtctcaacacatttgtctaccctacttcaaacatacgacctagtcaaaatgcagctccaaggcaggcacgctaacccatctagttcaggccttctctttcggctgttttaagtgagatcaggagatcagcaatgacctctcaccttcacaagacatctgggatcattaagggatgctttaccacatgtctccaagacactcctgagagttattgacccttcttgtcagttatctattgcctctcagctctgaatgcattcttcaatatatgctctacaataaatagtgggaattttccccctgtactctgagctccaacactactgccaaatggggctcatatcccaggccccagtgtgctagaggactgtgtcccagactgtctgcctctacaacaaggagcaggggcaggaggcaaatgatcagaagccctgcacttagcagtaaactgcttcctctagttcttcctgtactgggaggacacaaaagccccacctccaggacttcctatgcatgaatttcctgcctactccccggtcagttctggccacttctacaactatatcacacctttgtccacagattctagaaggtctgagagatgaaggcaaggacatcacgcttgaggccagaagccgtcccaacttccccacaggtgcaaccttccttgacatcctggttttttgggaggaattgttcatggcttggattttcatcaactgatttcctcacgatggcagtagtgctccagaaatgtcaaccagccctgtccccagggcctcttctcccgcccatcgagtatgaaaaaacgccaacaaaagacaaaagcacatggaaacaaaactgtttcaattcttgcccagtttgaggaaacttgttcacaccactgtgcttttgctttctatttccatcttaaatcaaaatgagtccttaaccaccccgccctggtcaggctcttccgttttccagcattaaatttccaccagatctttggcttcacagttcagctcttcttctctcaacattagttcttcagcattttctcaatttattaagttgacttcttaaagttgaacaagactcaggattccaggatgaaatgggagaagaaaacgccgtaagttccaggcctggaaaaggtcatctctagtcacctggcatcatggtccttgacgcagctttctaggttaccagggaatcttcctccattttgtagcagacactaatctttttgtttggtggaaggctgttatttggccgaattcctgagattattttcttatagcctatatagctctcattggtttgacatgtcatatgtgacataccaaatgtacctttatatttatttatttattttcgagacggagtctttcactctgtctcccaggctgcagtgcagtggtgcaatctcggctcactgcaaactccacttcctgggtccaagcgattctcatgcttcagcctcccaagtagctgtgactacaggaacccgccaccacgcctgactaatttttgtgtttttagtagagatggggttttaccatgttggccaggctggtcttgaactcctgacctcaagtgatcctcccacctcagcctcccaaagtgctggatttacaggcatgaaccactgggcctagcctgttcttaggaaactcttaatgaagaaatgtattaaacaaaaaggtgagttcttatctaaaaccagttttcagatgtaacttttctttgcactttggtgtatctattttttcatacacttaaaaacatatagttattcagtacatctgtcatgtgaccaatttgtctttgtaattatcaatacacttcttacaatgctaaatgtggaagtccaaacacacacacacacacacaaacacacacacactcctttttcacttatgtcattacactgaattcacaggtttgcattttactattttattttccttaacaaaacaatagtcaatatacgttctttaaagtttgtaaactgaatctcctacattattttcttagaggaaaccagttttaatatttctccatacttgattctagatgttttagtcagggagggctgccataaaagcatcatagatttttaaacaaactatatgtatttcttacagttctggaggctgggaagcccaagatcatggtggcagccaattcagttcctggctagggtcctcttccaggtgtgcagatggacatcttcctgttgctcacaaggcaaagtgagaaacctctgtcccttcatctccttataggggcactaatcataatgcaggctccacccttatgacctcatctaaacctaactacttcccaaaagtctcatttccaaataccatcgcactgtgggttaagactttcacatatgaatttcgaggtaacacaaactttcagtccttactaggttttcttttttttttttcttccctgtgtgtaagcattgtatttattatctcttgctatgtaacaaattacttcaaacttaatagcttaaaacgacatacattttttttatctcagtttctgtgagtcaggagtctgggcatagttcaggtaggtactcagctcaaggctgcgatcaaggtgtcggttagggctggggactcatctgaggctcaagatcctctgggaagctcatgtggttgttggcagaattcattttgttgcagctatagaactcataattgcttacttctttgaggctagcaaaagagaagatctcagaccaccaggccctcttttcctgtcctgattagatcaggcccccccagggtaatctcccttttgagaccctatcatttttgccatataatataaaggaatcagagaagtgataatctatcatattcacaggtcccactcatacttaaggaattatacagggagatggaatcatcttagtattctgcctatataccacaaggatggatggatggatagagagatagatagatacagtttttaaagattttaagtcaaaattatacatgaacacatttttcaacatcagttatttgtacaatactttacaaacaacattatgccatctctgacattcctccgatattgaaacacttttttttttttttaagacggagtctcactctatcacccaggctggagtgcagtggtgctatctcggctcactgcaagctccgcctcccggattcacgccattcttctgcctcagcctcctgagtagctgggactacaggcacccaccaccacacctggctaattttttgtatttttagtacagacggggtttcaccgtgttagacaggatggtttcgatcttctgacctcgtgatctgcctgcctcggcctcctaaagtgctgggattacaggcgtgagccaccgcgcccggctgattgaaacacttttaacactcttagcgaataagtttttactagcttatgtatccctaaatagaatgcccatattaccaatttataaactaacccatacattcataatatatactcttccttctagaagaatatttcactttctttgccctcactacacttcactaatatcaatattactacttcacttaacatccatcctttcttcccatcctcccaatgtagctataattgcttgtgtcaatgtttaatgcatacaatactatgacaatgtaaatatcttgagatgatccatgtactaaattgtgtttgcttttctttttctggacatctttcctctagtctctgtcccctagaataatttactagtcatttcatttgatggtctgtgtactcatagttcattcaaacacacacatattcaagttgactaaaatatctctcaggagtctcattcatattacggatcttgatcaatttaattttcctcgcaaaatttatctcaaaattttctgacctcctccaatgtgtccagtttcccctatgcctggtgccccagcactttgggaggccaaggcgggtggatcacttgaggccaggagttcaaaccagcttggccaacatggtgaaaccctgtctctcctaaaaatacaaaaattagctgggtgtggtggcacgcgcctgtagtcccagctactctggaggctgaggcagcagaatcgcttgaacccctgggaggtggaggttgcagtgagccgagattgcaccactgcactccagcctggcgacagagcgagactccatctcaaaaaataaaataaaataaaataaaataagccaggcatggtggcacatgtctgtaatcccagctacttgggaagctgaggtgggaggattgcttgaacctgggaggcagacgttgcagtgggccaagatcacaccactgcactccagcctgggcgagagagcaagactctgtctcaaaaaaaaaaaaagactcttactattgatgatacttaataatctggaattgtatttttaaatatattaaaacaatagatgtttcttatcttttataaagcatcctttcatgtgaaaaatgttttttaaaaaagaggcatgagcacccattcataaacagtatgtggtagtacagtaactactatttgcactttggtgtttatcatctcagatctctcaatatgtagaggaaatcatacattcctttaaccaatatttatctagttgctgccaagttccgggcactgttctaagccttggggataaaagaatactaaataggatatttaattgaatagaatcatttaactgaatagaattatttaatatttaacttaatataattcagttatatttatttactataatatcagttataatatttaactgaaataattaatatgtaattgaatataatatttaagtgaatagaattattttaattgtgcacacacacacatttacacatacatgtctttatatatatctctatatttgtaaaattgtatataacttaatgtgcatgcatatatacatagtacatataaatatatatatataacaggtatgtgtgcatagatataggaatatgtgcaaatattggtgcatatatttataaactaacacagtatatacataaacacaatgtgtgtaggtaattggaacgtcgtaaacactagtaaaattgagtatcttttcatttatttaataaacagctggagttcttcttttgtaaattgcctgtttaattcctttaccaattttgccgttggtttaaatacgacagaaacagaaagttttaaattttttagtcacaggacgcttacgcgcaaacacacatacaaaaaatcatcttcaactactctatgaggtcaaatgctaactgagtgaggaaagtagaagagggcgccagaatgtttctccattatgcaatgaatcccaagtaattctagacattctccaccaacttgggaacaagaagtatgggttgtcaggcttaccaggtatcctcatctggagctttttatgaagaagtaacagagaagaacaattgttatgtatgaggagaatcactagacttcaaggagttcagcatcctctgggagaacaaataaagagatgagcactccttccttcttccccaccaaccccaccaagagacctgagatgacggcaaaactctattaggggacaggccttggctataggtgtaacattttttggcctcttagtgtatgcctctgctctctaagcaggagatttggccttttttggctcggcgggatggctcccaatgcttcttcatttccctccttgctctaaggcaatggggtccagacttttgctgtgtatgagatcccccagcaagcacaaatgctgttataagttatctcctcaaattagcctattttatgagctgtgatgctgctatcacaaggagctcaggttctatggctccagaacaaggtgaattggcctgaaccatcttctgagggacaggggcaggaacaggagacaatgggcacaagccctgcactgggccctgaaagttttcctcaacggaagccccacccgacaacttcctgtgcccggacttctggcagctgttggctctgtccggcctcgccaacaacaggtttttacacttggatatcacctttgtcatattagcatcaagtctttgcccagagctcccggaataattcagagaagtcagggaagcccaatttcgggtcagggcctgttcaatctctccgctgaacgggcgtttctaaaccgaaagacctcacgggacggacgctgtaatggcgtagggtattttaaaactatttcctcacgatggcagtcgtgctccagatatgccaacaagtaccgctccctagtccttctcccgccctttctgtccaaaaaaacaccagcaagaaaaaggcgccaggaaacatggcagccttacttttgcccagtttgggacaatcttatcacgctgctgcactgttgcttttggtttccatttgaaacgaaactgaggccttctctttttaagaactgcatttccaataggtttagctttcacagttgtgttctcgctcactcagcatacatctccagtattttcccaagttatcacgttgtctgcttctggattcaagactcaagaatccaggcctaagcagaaaaagaaaatgctacaaactcaaggccgggaggttatctctaagtaccaaaccacatgtccttgcctggctcatccatctgtaaggctcccaaggaattctatattttcaggatagagatctaagtcttatgtgttgacttgttggcagccatttggctggagtcttaagagaagcgcccaagtagctcccattccaagagttttgtcttgtgatttcatttaccatttgaagacactttccgatgccattaagtggtctccaattgcttcctaccactttattggatatgtagggacatgtgtgtgtgtgtgtgtgtgtgtgtgtgtgtatttatctttatatctgtatttaccatttatctcttagagataagccttaaaaccacttcctcattagtaattaagacatgatgtttgccaaggattcagaaataaccatgcactgataaagagtaaagcgctgtcataaaattgattaagaccactgataactttttggatcatgtcctcttactcctttcaatacacacagagttttatatttatgttcatatgtgacaatgaatttatattaaaattggttgtttgtacatgatggtttgcctaggagattgccactcctgattctcagacagtttggccacattacataaaatttttgtcttcatgtttagtaatcaaaacactgcaaaaaaatgtttcttggctgggcgcagtggctcacgcctgtaatcctagcactttgggaggccgaggcgggctgattacctgaggtcgggagttcaagaccagcctggccaacatggtgaaatcccgtctctactaaaaatacaaaaaattagcccggtgcagtggcgcgcgcctgtaatcccagctactctggaggctgaggcagaagaaccacttgaacccaggaggccggaagttgccgtgagctgagatcacgccactgcactccagcctgggctacagaacgagacttcgtctcaaaaaacaaacaaacaaacaaacaaaaatgtttcttattgctccatttattatagtttaaatatggcatatataatatataatattgctatacatatatgtgcacatttatttcaccttaattataacttgacttatactgggcatagttttatacaaagtcttctgcaccaacttacataaattgcatgtttccatatatcaacatctattttccctagctggaaatttctttatacttgattgtacaaggaggtttctcttcgaaggaattataaaggtaacatctgctgttggaaatctgctcatattttaagaaattacaaagccaaaaataaatggtatctcaatgaaaactagaagaaataacttttaaaatgtctttgccatacattctcttatcttccctatccatatataatgtacattttttaacctaaaatcccagttaccttgtatgtcagacatgcttttctcaggacagtttgaggtctttggaaacatcattaactactccttggaatatgcaatatttttaaggttgcttctcatatttttgcatttcctaaaattaagcatacctgtttacaaaataaccagacacattagccttgtacaaagaagtgcagtgaggccacaagtaatgcccactgaagcagataaggatttttaaaatgtgggtgtcttgaatacacctgttttctgtgatcagttaaatatataaatatattaggtctcaaatagccaacaaatcaagttttcaccaacaatttcttctgcacatatttgttctgggttgactctcaaattacaaatatcttatcagcttcttgaaaaatctcttagaatacacaatctatgaagaacaaatggaaacactttatcacaaatcccacttttttgaggcatccactattagcagcttgatgagtatattggtttaaacattaaaaaaatgatatataactgttcaataagaactgatgttattcagtgaaataaatttaatctatatctcattaatatactccccacattcctcagcacaatgctaggcgcgcgcgcgcgcgcacacacacacacacacacacacacacacacacacacacacacttccatttcttttcttcaaatccatcctcattggtcccactacacatagaatttggtgccctgaattctcaattcaacactagaaaatgagtactctccaatatcattaacttttcttgaggaacaagatagttttttatggttaaatctcatagcattcttttactgttgatcaaaccgtaagaattatatgcatctggaaaaaaatcagtaagtggaacaaatatatagcagtaaagaaatgatactcttaagaagtttaatagatattccattgatgtttgttatattgcattctgctctttttattatataattgtacatgtgtgggcacatgtggacaggttgtcaggatttggtgactttttacttacatgatatatgaggaatatccttgcatgatacatgaggaatatccttgcaacttgagttgcttctttctatcatagttttctcaggtctcacatcacataagtctcatcatatgtcgtgaaatatgcttcagaaagctggattttctgttaagtaaaatttggaaatagaatttcagaatagagcctttaaatcttgcatgtgtgtagaagtgtgtatgttttaaagaaaaatacatcttgtaatatgttgttttcctaattatatattgagatgatgctggtttcttgatttttaaaaaacttgcaaatgtaagcttttctcattttcaacatttcaaggctttggacaagtgtaagttaaaacgtgaaggcaagtcattagaaacatcactgtagaaaattacacactgttagttgcttgactggggaactttccagataacttcctttctgcctatttgcttttctgaaccaataggtttatgtgttcaacttgaattaataacatatgtaattaagagagaaagaaagacttcatctttcatttctatttccttgctattagccaaccagaatggtttgattcccgttacaacatttcacattttcttccctaaatcagaggtgtggtcatctcccctattgaggacttggcgaatggatttcaatctttccaaaggcttaaaaagactacctactatagctgaacttactgtagttgaacttggacaatggatgttttgccccctccccaccgccatccttgcaaaagaaatctcagcgatcctctttgtcctctcctttctactttcctgtgggagtttggctgtgcgatcactttcaagaggtagtctctggacaaagggtatgctcatgtgaaaggttaaatgatttggcctgttgaccttcaaagaggtgtaccaattaacagtgcttctcacctggtaggaccttgtccaattctacaaatcattacacaaacactgacatcaatggattccttttcaaaggcttgctcggggttatgatgaagatttaagggcattatggaagaatacagtgaactgcaatttacttcagtactggtgaatttgagactgtgataatagaggtgccttattcctttgccatctttcctgctgagtggttttctttttaactacattttgaaacagcttttgatctgagctgactgtcaatgattgagtggtattgagagttggcaatagttataatctcccattcctggtcacggtgtcacgtttgaattcctgggactcagcaagttgctgctgctttaggcctctatccactctctgaccagatagtctcttaatgtaaaccaaaatgtgtgggaatacaaaattcctgaccctgaggaattctagggctggggctacctctctgtcactcacaattctaagttaagttatggtgcactgtctccacacatctggctttcctagtctagcatatggtcaagtcaaactgtgactcaacagcaggcagcctaacccatctgatgcagggtttctctcagtcacctgcttagctgaagtaggctgaaaaggtcagaggtcaccttacactttcataaggtatttgagaccattgagacatgctttctcaaatgttttcaaacccttcttggctcatgtcaacctataacatcctcaaggacagctagaccaaggcatgaatagcaggaaagtcaatttccccagggaccctatggtctttgtagtagttgctaaaaacttcctagtagatgttatagctccaccctgggcaagtagaattcaggtggtgaccatatgttacagcagtgcatgagaataacattcctttctcttctgtaagtggtcagccactgaatccatcactgatacacgagaaaactctcacatgcagtcaatcttacaaaatttttgccttttcttgctatgctatgggcaagtgtcctgagggtcctgatgtgctcagcttttagagggcttacaaggaatcttcattagaaaaaggctaagaagcaggcacagagaacaatacttgctaatctgaatgaacagttaggtcccaagtctcaatggcctcatcttccttaggggaaggccaatagctaaagaactcatttctgttcctttaatagagctaagagtaggtttctctaaataggtaggccttcacactgggccctagaaaaagtgctgcaaagccatggtagctgttacctcctggcttcagaaaatacttccaggtcttctggttgtgtatatctgcactcctattgatgttcaaggatttattggcttggccaagtgacacacactgccttctcctcaggtcttccttgctctaggcaatgggggcaccagacttttaggtatccttgagacccccagaaagcacgctggctgctgttagatatcatctggaatgagatgtttcatctgcaccctaacattgcttacaccttgtgccaaccccctacctcattgttcaaagggcatggccagaggatatgtggccagaagtccccccaaataggatctgagccatttgttttagccccaccctcactgggtagatatctaagccccaatacttcctatactccacctgcctagtagctgtcccttcagtcctccccctgaccccccacttatcagcttctcccccaggatcctgcctttgtccagagctcctggaaggcttcagatttaaagtgaaggggacctacttagggctagggtccactcaacctcacaaaaggcccaacatttctcagttgctaaaacttgggggggctctaacaactttgggtttgtgttttgtcaaactacatcctcttgatggcagtattgctctggaaaagctgattagccttgcctgggcaccccacccccagagcccttctcctctcacccattcaatctgaaaaaagctaccaagacaaaggagacaggaaacaaagctgccttgctattggccctgtttggggaaaatctgctctttcgaatttacttttgctcctggtttccctctgaactcagactgaagcctataccacccagtttcatcagccatactttgtttaaagaatcccatttccgatagcattaggagatatacctaatgctaaatgacgagttaatgggtgcagcacaccagcatggcacatgtatacatatgtaactaacctgctcattgtgcacatgtaccctaaaacttaaagtataataataataaaatttaaaaaaacaaaaaaatgcccatttccactctaccatagctttgtaggtctgctcttcttcattcaaccttgatccccaacaatttcccaagttatctgcttcagtgggaaattcttagggacctagggctaagaaagtgaagaaaataatggaaataacagcctagagaagaacaaatctaggcaccaggccatgtgacttgtttcactgccaggttccctgggagtcctccattttctgacctgggcactaggtcttgtgtattgagttgggggcagccatgtcagaaccctaataggagggtccagatagatctcaaggctgaattccatacaatatccctcttggggtgacacacacactccaaacttacaaaattccagtagaaaggaacatgattttgtcttatggttccatcattcaacattaaaacacaagcaagttcccatgcacatcattatttgacttttaatggcttcctatggctttattatatatgtgtgtgccactgcttaagcttaggaatcagtcttatggtgtttcctcataagtaattaagacatggtgcttgtaaagaatttagaaaataaccatgtgctgatcaagaacaaaagcactgtcataaaatcttgtattaaacactaatagccttttgcatatttactcccattatttcaacatgcacagaggtctatatttacggtaatacactacaataagcatatttaaattaaatttatatatgcatcatgttttagatgcaaacttttcactgctcattcctgggtaactgaaattgtcatgaaatatttgcaagacctggattttagataataaaatatttgcaatgagcttcttgattgactaattcattaaagaatgttaggttctcaatttttaaaaaatttatacacaggacataatacctataatgccaccactcaagtatcttaattttgatacctgccttacctaatcattagtatgctgactatatatatatatatatatacatgctaacattggaacaggcactatgtgcttatgcctcagaacattagggtttcttttgtttatatttttcaaaacttataccaaaattttatcttaaaattttatgtaaaatctataaagttgaaacgcatactcactctaacactgaccatgattatgcatgatatgcataatgcatatatatgtataagcattagatagataggtccaagttacctggttacaggcctagagggaaaagaaaatgattgcacctattatatatatatttacttctctttatttatttatttttattcagcctctgggagcatggactatccttttctttaaagacaattgaatgcaaactggatacagttttgcacaaattcttcaacaccaccttataccatttgcatacatgaatgacaatgtatatttgagtgcttggattttttttgtatcttactctagaagacctttctatttcaagaaattacaaaagttacacccactgttggcaccgtttagattttaagaaattataagtagaaagtaaacggtacttcaatcacaacaagaaatagccacttaaaaatatccttgccatacattcttatatcttcactttgcacaaataatatacacttaaaaaatgttcaaattctcttgtactttgaatgctaaaacaagttttcctcatttgtaacttgaatgctcttcaaatctcattaagtattctttagaataatgacaggttttaaaatcttgccacatgtttttgcatttctagaaataatcatgcttctttacaatgtacctgctataacagccatgtatggagaagtgaagcgaggtcacaggtaatgccacctccagcagacaagaacttttaaaatgtgggttcatcttcaatcctcttcactcggttttggttctcatctgtttgtgcgtggtcagctctcctagcaaaagtgctaacccttcttggtttggcgggctgatcccatttctcttcaaggtcctcctagctgcaagcaatttggttgcacctgggacctccagcaagcacatggcatccttttataagcaacctggtattgtctggttctctgcagtgactctgctaccacaaaggtcctaggccccagagcctgaaggcaccacgtgtcagcctttcccagactctcaggggcggggagagagacgaatacccacaggcccagtacttcgttggttggtggcttcctccagtcccgcccatactgggagaataccaagaccccaccctacaacttcctgggcctggacttcctgccagaggccgacttagtcttccctccccacgggccagttcctacacctggacctcactctgtccagagcttcaggtaggcctcaggaggtggaactaagatccagctcatggtccgagcctgctcagcctctaacagaatggaactttccaatataagccctctaagggatggggctttttccagaaatttcctcacgatggcagtgttgctcctggaattctatccaatactgcccccaagccctcttctcccgcccgtctggtatgaaaaaaaaatgtgaccaacagattaaggcaccaggaaatatggctgacttgagaaactcgctcatactattgtgattttgcttttggtttttcatctgaaatcaaactggcgcctaaacctacactctcatcaggggtcttttcagttcaagaactcaatttccacttacctagtcttcacagttctgctttttcttcacctaactttttctcatggtactaaattgtcttggtgtatcaggggtcaaacctcagggatccaggcctagagggaaaagcaaatggttgcatctaagggcttggagaagagcaaatccatgttgttcttgcctgactcacttcccaggtttcccgggagtcctactcaatttctggcctaggcactaggcctgtgtgttgagggagaagcagttgtctggaaccctaagctaagtgtctagatggttctcaagactgcgtgctatacagtgcccatttggaagggtacacaaactcaaatatgtataaattccagtcagaggagactgatacagtctcatagtcaaaataatttaaaatcggaacacaggcatgttcctatgttcttatatgactgtcaatggtttcctgtgactttagtgtgtatatgcttatcacttaggggtcaatcttatggtattttatcttacgtaattaagacatggtgcttgcaaaggatttgcaaaggattcagaaaagaaccatgtgctgaccaagagtaaagcactgtcataaacagtacctattagtaatactgataaacatctggattatgttttgtgaactaaaaagtgtctgagacaggtctcaatagtttcagaaatttattttgcaagtttaagtacacgcatgcctgggagataggtccatgcctttcttcaaagatgattttgagggcttcaatatttaaaggggaaagggcagatactggggaaaggggaagaaattttgaaaagatgtgggtagataagaggcaaagggtagcattcttttgagtctttgatcagcccttcataggcgagatgagggtagaggaatagtcacgtacacattcatctagctcagtgaatctgcattttttacataggataaaataaacacagggcagaggaagcaatcagacatgcatttgtctcaagtgagcggagggaagactttgagttctgtcttttgttccatacctgtgaggataagccaaaatttacattgtcagggtgaaattcaacagaactgtttcagggtaaaaatcttggggctcacaaggaatttcctagtgggcaaattgtgagggagatatgtagctttttgtttttgctttgttcaatcattgtagccatcttatttaggaataaaatgggaggcaggtttgcctgacgcagttcccagcttgacgtttccctttggcttagtgattttggggccctgagatttattttcctttcacagtttcaacatacacatgcaaactcatatactcatgcactcatttcaatatatacacataaacatttatatttcgtgtcatacacaatagtaagtttacattaaaatgaggtttatttgtatgttatggtttggagtatactttcacttctgtttcctgggcagtttgtcattatcatgaaaaatttgcaagacctgaatttttagtaaatgaaacattaaccaagagcttcttgattgctacattcaataacaatatggtctctgaagacatgttcacttcataaaacacttatttaacaactggaaatttaattcctatgatgtctcctctcaggtatcatgatttgaagagcttctaatctttattatgctaacatgtgtatactctaaaacaaatattgaatcacaagtataacatgcgtgcatcagaaaatataggatattccttccttctcaaaattttaacctacaattaaatctaaaatttcatcttattttatttatttattattatatttttagagactgggtctggcaagtctatgcaatcatggctcactgtagccttgacctccaggctcaagcaatcctcccacctcagcctctggagtagctaggaccacaggcacacaccaccacacccagctatttttttcttttttatatttttttgtagagaaggggtctccttatgttacccagactgatctctaacttgtaggctcaagcgatcttcccaattcagcctcccaaagtgctgggattataggcatgagccactgcacctggcctaatcttattttattactaaaaaaaattaacaacagattgcattactgtataaataaagtctgtgtcctcatctctttagcactgtgactgtgacccaaacacgtactccatcaaaggttcaaggtgaatgcattgacatatttttatattcatctataatcttttcttaatgtttccctttaaatttatttatttcctaaaaattaggtcttgcaaatttttcgtaatgacaaattgccaaggaaatagaagtgaaaatattatccaaatcatgatatatgaataaatcccatatgaatgtaaacttattattatatatgaagctaaatatcaaagtttctatgtgtatacatatacacatgtacacatatacatacatatacaaacacacattaatatacggacaaagagagtgaaatttaagtgcattgttactataataatcataattaaaaatatacactttttagggaggctgaggcaggagaatcgtttgaacctgggaggcagaggttgcagtgagccaagatcacaccactgcacgctagccctggagacagagtgagactccgtctcaaaaaatatatatactttttaaacataagtacacatatagatggatatggagtcatgcctaatttaatgacagggatacattctgagaagtgcattgttagttgatttcatcattgtgcaaacatcatagtgtacttacacaaatctagatagtatagcctactacactcctaggttgcagaatatagcccattgctcctaggctacaaagtggtatagcatgttgttatactgaatactgtaggcaatagtaacaatggtaagtatttgtgtatctaaacatagaaaaggtacaataaaaatacgatattataatattatgtatgacataaccatcatatatgcagtcagtcattgacctaaagatcattatacagggcatgactgtatactaatgtgtagtttatctatctttaaacataattgaatgaataccgaaggtagttttgaacagaaacatcatcattatctcatacaatttccatgttcccatatacatatatgtacttggagaacttgaaatctttttattctaccctggaaagagccttattatccagaaaatttaaaaagcaatagttgctgttggcaaactgttcagatattgagaaatcatgaagccaaaaataaatgatagttcaatcccaacaagaataaagacttttaaaatgtcattcacccagactgggcaacatggtgaaacctgtctctacaaaaaaatacaaaaattatcctggcaaggtggagtgtgtctgtagtcccagctacttgggaaactgaggtgcgaagatcacctgagcccagggaggtggagacttcactgagccaagatcgtgccatagcactccagccagggtgacagagcgggactctgtctccaaaataaataaaagaggccgggcatggtggctcacgcctgtaatcccagcaatttggaaggccgaggcgggcggatcatgaggtcaggagttgaagaccagcctcaccaacatggtgaaaccctgtctctactaaaaattcaaaaattagctggacgtggtggcacatgcctgtaatcccagctactcagaaggctgaggcaggagaatcgcttgaacccgggaggcagaggttgcagtgcgccaagatcgcgccattgcactccagcctgggtgacagagcaagactctgtctcaaaaataaataataaataaataaataaataaacaaaatgtcattctcatctcttatgtacatataataacattaaaaatcatattcaaattcctttgtaccttcagtgttcagatacattttctgtacatattgtagctagagtactttccaaacttcattaaatattctttgaaatactgattatattttagagagtagcctcttacttttgggatttcacaaatcagatgtatttctaaataatgtgttcaggtacaacatccatttttaaagaagcatagcaaaatcataggtaatgccacctcaagaggacaaggacctgcaaaatatggttgtattttcaaccatatttcacagatatatgttgtatacattcagagatatagattccttaggactctctcatgtgttcaacacagcaagttttcaccaataatttcttttgcacttttttttttttttttttttgagacagagtctcactctgttgcccaggctggagtgcaatggcgcgatgtcagctcactgcaacctccgcctcccaggttcaagtgattctcctgcctcagtctcccgagtagctgggattacaggcatgtgccaccacgtccggctaatttttgtatttttagtagagaaagggttttgtcatgttggccaggctggcctcaaacccctgatctcgggtgatccgcccacctcggcctcccaaagtgctaggattacagtcgtgagccactgcacacagccttctgcacatatttattctggatttgttattgaattacaaagataatagaagcattatgaaaaatttcatagagtgcacgaatcaatgaaagacctaaggaaatactttatcccaaatcaatctatcccaagggaaccactattagcagcttaatgggtacatgtattcaaatgttgtaaataaggtgtacaaccactcatgagagctgacattatttaactaaataaatatatcctactgcacatcaataaactcccctatttgctgacaagatgcttggagcatacatacattcatccagggaggaatataccatttattttcttcaattacattctagttaaaatgtaggtggagttttgtgtcattgtttcttcattcaacattgaataatggatactgaatagcatatctcttcatgatagtactttatttttaatctcatacgattgctttgttgttaagttcttaaggataatagatgcatctggcaaagaaatgacaaatgagtaatcgtaaaacaggaaagagaggatactctgaatcacacaaactcaattgatatttcaatctagtacattccaccttttcttctatatacacttttgcatgggagtgtacaggggttttttggtatgaatttaaatggacatgacctatatatggaattctctttttaatttatttttcttttttatgctttactcaggtcttttatagcgaggccacttacaatgccattaagcatgccaaagaagactggattttatgttaagtaattatttgccaaaagcttttctttccatgaccattaaaagtaggacattaatcatttcaatgtatatatagaagtgtgcctattcttatggaaaatagaatctgaaataaaacaatattgtataacttgtacctttattaaatgtatactaggaccttttttgggttttctgtaaatttcagaatcaacccttgctcgttttcaacatttcaatttttaagacataaatagttaaaacctgtagactctaacttgtatttttgagatacaaactatactagtgtttgattagaagccttccagaaactgtacttagtacatattcaccctctagaatccgtatatgtttatggttctgtgtaacagtagagaaaaacagtctttcataagagtaatcctcatgattttgttttacacattagtttcttagggataccaaaagcatagccaaccaaagaaaaaactcgacaaaccagatttcatcaagttttaaaaaagttgtttcacaaatgataccatcaagaaagaaagaaaaaactcacagaatgggagataatgttttccaatcatatatttggtaagggacttgtatccagaatataaaaaactcttaccactcagtcataaaaatataactcttttaaaaatggacaaatgatctgaatagatatttatccaaagaagatatgtatatggctaacagcatgtgaaaagatggtcaacctcattagctattagagaaatgcaaatgaaaaacacagtgaggtactacttcacagcccctaggttgtctatattttaaaaagacagataataacaagtgtcagtaaggatatgcataagctgcaagcttcatatatggcttgtggaaatatcacatggtacagtcactttagaagtagtctggcagttccccaaaagtttgaagattctatcatcatatgactaatcaattccaaacctatttatctacacaagagaaatgaaaacatgttcacacaaaaagtagaaacaacttaaatgtccatcaactgatgaatatatataaaaatgtggtatatccatacaatggactgttattcaaccatattgaagaatgaattattgatacattgtacaacatgaaaaatccctcaaaacatgctaagtgaaaaaaaccagacacaaaagaccatatcttgtaggattacaattatatatagtttccagaataggcaaatccatagacacagaaagtagattagtgtttgccagggactagaggaagctgagaatgagaactgctagtaggcatatttctttttggagtgatgaaaatattctaaaattgattatggtaatgattgcacaattctgtgaatatattgaaaaccaccacattgtacattttaaattggtggaatttatagtgtgtgaattctatctcaataaagctgtttttaaaagtttcaaaaattaacaggttaattcacatttataaaattaataagaaaaagcatataatcatctgaaattgtgtagaaaaagtatttgacaaacataaacaccaatcctgattttaaaaaactctcaccaaactagaaattgaagaaaatatatcttcaatatggtaaaaatatacaactaatgtcatacttaacactgaaaaagtcaacactgtttttaagacctagagcaacgtgaggaattcgtctctcacctcttctattcaacgtcataccagattttctaagaagtgcaattaggcaaaaaaaaaaaaaaaaaaaaaaaagaaaaaaagattacagtttggaaagaaagaagtaaaagtgctttcacagatgacagtattgtttacatagaatgattcttcaaaaacacttctaaagctgctaaagtccatatcttacagacaaggtatgattggtgttgcttttgtatctattcaaaaaaactgtgtcttttatgtggaatgtttaaccattaacagctaatgtatttactgataggttttaattttgggctacaattttatagtttacattgtttgtcctcattaatttgtattcttccatttcccctttccttcctttcaagtattagaacactttatcttttagaattctattataatatgtctgttggccttttggctataccactttgtgttattttttagtggttattcttgcgattgcaatatgcatccttaactttttataatcttctcagagttgatattttaccgcctcatacagaatgtaaaatccttataacaatatacatacttttactattcctcggtgtcctttatactattattgtcatatgtaatttatgtacatacattataaacacagcaaaatgatgttagaacttttgctttaagcattcaagtatattttaaaggaactaagtgaaaattttttttgtacattctcagacactgaacatttctgatgttctttactctggaacatgttctggctctggaagatctgtattttcccctgatgtagttttcttcaacctgaagaatgtcctatagcatttattttattgcatgcctaccagtgacaaagaatcttagttgtcttttgtctgaaaacatctatttcaccttcatctgtgaagatattttcaaggatggagaactctgggttgattttttttttcccatcagcactttcaagaggacgtgacactgtcttgtagcctccatagtcactgatgagaaagccatagcttttaaaataaaacatgtgatatatgacagctgcagcgcttcagttctgtgggggaaatgactgagttttcaatgagtggtcttgggattactgggcatccgtgcgtgcaaatgaaactttacttctccctcacagtgtacacaaaactcaattccatagtctcttttcaggtactcatggtgaggaaattcattataaacctgcacttgtgctatggaaagcccaggagaggagggagggctttgatggatttgagaggtgagaatgaatgtctagccaggggttggcaagctaactcacagaacagatgtggccagtgacttgtatttgtaaggcctgaaagctaagagtgatttttacatttttaaagctttgcttgaaaaaatggaggctatgtgaccgaggccacctgtggcttgcatagcttaaatcattcaccatcaggccttttacagaaagagtctgctattctctgcatctaggaccaaagataccttgacccatagtttctcctatgtagggacaggacatgttctagaaaccccactgtggtctaatgtgcacgtcctcttcatgaggatggcttcactgacataaacataagccggaccagattagcatttcatgtcaggccaggccccagaagcagagtagaatgagatccagacacaagttctaaccgtatctgcgacatggccttacaggaaaccagtggaaatcattcctcagtgaaaggcagaggcctaggaaatggggttggagccggggtgcgtgggtgggcatgaaggttcaccctttctggaggacctcccagaccacagaatcaagggggcacctcctggacatcttctcactactgtgtatcttccagtcttgatttcttaaaagacagtaaggtgaggggataaaggatcaggtgtgtgtgtctaatagttggtgacacttaaagatggcatcaggactagtgacaggatgaaaccaaaggtgtgtgctttggcgatcatatggacattgaaaaagagtgatctataggtgaaaggggtcttggtagcagtcagggatcaagtgaagatggggttagtgaaggtcaggtgtgtccacaatgcaggatttttgcaattattctgagtgttaggatcatagttagggacgggatggattgggaattttgtgagggttgaagatgtctgtttttcatttccttgataataggaagcaccgattttacatagggtaagggattaggttggaatcagggatagaggtcaagttaggggtggaaggagaggtggaagcaagtgtgaggataagggttgtgccgagaaggaatacatattgcttcagataagcagtgcatagtaggatggattggggtcaggaacaaagtggggggctgctattctgacatatagagagattacacatggcatctctgagtcaaaaggcgggaggaacctgtaggccagtggtggtgactgtgaaccctctggaagtgtctttgctgtttgtggcccctgaatgtgtcagtcggctgtgtgtgccctgaatgcctccctgccagagcaggagcgcagtgaagcctttatgatcaggaagggtcagggccggccatttgggtcccgggcaagggaggagctgggccggctgcggacccctcggcagccacgttccgaagggacagctgaacccacagggtggagtaggaggtggcagctatggagaggggagcaggtagggtccccgggccttactccagagggcgagaaggaaagcatgaagggctcggtctggcctaggagggagcccaggctgcctggcagaagagactccgggggctccagtccaggccctgatggccgagaaaacgtgaggggcccaacagggctctctcagggaaggggccgcccctgtcctctccatgccaagacggcctaaactccaccaagaatttcccgtggttgcagttcccccagccggagccacccgcaactggagcaggcctctctggccaccctttccccaccttccagctgtggcccttacattgtgtgtgtcccaaaacccactgcggatatcatggcagctgtgggaaaatgcagcagaattgctgatacagaggattctaggagttttgctttctcagaacctccccacccctcgcctcgccaagccccgggttaggagcccctgctccccacatgtttctgcgttgtgtgtcatacatcctattggccactagatggcgaaagagaccttggcaggacgtctcacctcttcagggatgagggcaacgttttcacaggtccagtttttcctgttccaatgggtgaaattagagctcaggaccaaccagcgcccccatacttctcacacacatatttgagggaatgaaggctaaaaaccacgttctgctgccgcctgggatactcctccccttaccgccctctcccctctcagatcccacagtgtgaatgttcatctccacaaacaacgtgggtaggataggcgctggggatggcgctgtctttggctgttcccgtgttccttgtgcctgctgcctccctcggctcagcacaattgacgccaacaactaacaatactgtaggcttgtctgaggactggggtcccgtcttagtggctgtgtgactttgagctagttaattaacctctctgtgctcgggttttctcgcgtatgcaatgaagattgtaatcgtgtacctatgtcataaagttactgtgaggctgaaataaatgaacatttctaaaacacttatgaaaatgtttggcacataactgcacatccaatatgtgctagctattctaattgccatcttgccctgcagagtaaggcctcagtcattatttgtttttcttggcatttcctatcttgagctcctaggtttcgactatggactctgtctctggcgtcaccaactatgtctggcagttgggaactgctttttaaaaactaattaattttggccgggagcggtggctcacgcctgtaatcctagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctactcgggaggctgaggcaggagaatggcgtgaacccaggaggtggagcttgccgtgagccgagatcgcgccactgcacttcaacctgggagacacagcgagactccatctcaaaaaaaaaataataataataattaattttttcaatttaaggataaaacactgtatgtatttattaggtacagcatgttgttttgaaaacgcatacattgtgaaatgcttaaatagaactaattaatatatacattatctcacatgatttttaaaaatgagaatacttaaaatctactctcaacgattttaaagaatgtaatacattgttactaactataattaccatgttgtacaatagatctcttgaacttattttctcctgtttaattgaaagtttgcatcctttgactagcatctccccaactcccccaccctcacccatagtaaccacctttctactctgtgcttctatgaatacaacttttttcgactgcacgtttgagtgagatcatgtggtatttgtctgtctgcgtctggctcatttaacttagtataattgtccaggttcatccatgttgtcacaaatgacaggatttccttctttttaaaggtggaattccattgtgtgtgtatgccatattttctttacacatttagcctttgatggaaacttaagttgattccatatcttggctattgtgaataatggtgctatgtacatgggagtgcagataccttttcgacatactgatttcatttcctttgatatatacctagaagcatgattgttgaattatatggtaattctaattttagctttttgagaaacagccatataattttctgtaatggatgtactaatttacattcccacaaacagtgtgcaacggttcctttttctccatctcttcagcaacacttatgactttttgataatagctatactaacaagtgtgaggtgatgtctcattatggttttaatttgtatttccctgatgattaattatgttgagcatcttttcatatacttgttgaccatttgtacatcttttaaggaatgtttccaggcacggtggctgacgcctataatcctagcactttgggaagctgaggcagacgtattgcctgagctcaggagttcaagactagcctgggcaacatggtgaaaacccgtctctactaaaatacagaaaattagttgggcatggcagtgtgcgcctgtagtcccagctactcgggaggctgaggcaggagaattgcttgaacctgggaggcagaagttgcagtgatccaagatcgcgccattgcactccagcctgggtgacaagagtgaaactccgtctccaaaaaaaaaaaaaaaaaaaaatccattcacatcctttcatcctttattcattttttaagttgagctatttgttttcttgctattgagttcagttccttatatacttttgatattaatcttttatgagatttatggtttggaaatattttctctcattccataggtgtctcttcactctgttgattgtttcctttgctgtgcagaagctttttagtttgatgtaatctcatttgtttatttttgcttttgttgcctgtgcttttgaggtcatatcaaataaataattgtccaaactaatgtcatggagctttttcctttatgttttcctctagtagttttacatttccaggtcttatctttaagtctttaatccctcattcattttcagttgatttttgcatgtggtgtgagataagggtctagtttcattctctggatgtggatatctagttctcccagcattgtttattaaacagactgtcctttccccattgtgtgtgcataactcctttttgatctcagttttttgtgtttttattttgatttttttagagacagggtctcacaccatcactcagactgaagtgcagtggtacaatcacaactcactgcagcctttaactcctgtgctcaagcgattctctcaactcagcctcctgagtagctaggactataggcttgtgccaccatgcccagctaatttttaaacatttttttcctagagtcaggatcctgctatgttgctcaggctggtcttgaattcctgggctcaagcgatcctcctgccttgacctcccaaagcattcagattacaggtgtgagccactgtgtctttctctggtcctagttttttgttgtgttttttttttcttctacagagctttggtgttgctgttactgcgtagagagaggcctgacattatgttactagagtcccactgttctctgagaacactcgagaaaaatagaaatttctctctccacctacaggtcgaaatccttccccgctgatataaatatttgagttggggagcagagcttcagggaccatgaagaaaatgctgctctggggacactaattgaactttcatctagcaggtcctgtgccctacctactcaagaacaagttctgtttgatgaagaagttacacagctgccaagttccctcattctactacctatctacccccaaattcaggaatgtctccatatgttgactatgctgactttttcagtgtcctagtggaaccacagcttaaaaaatgggaaatggaggcagtcccatatggcagagtctccgatgtggaattaggcatcgttctccaaaagccagcctgcagcccctttggagagcttactaaactataaattgtcaactgtattacatgataaagcagatgtgtccatacagtaactcttttgctaataaatgaggtctaaattccaaaaatagaaccaagtgttcctaatgagtgcatcacaagaataatttcagtgaatggaagaacaaggcccattaccaaggaaggtgcttgcaaggataagactatccagatagtgtataatccagctggacagcttcattaacatttccctctctgccagtgtctgagctcatcctacaaaaaaccatgacgcacttccagatttatgtaaagataggcgaagttattcataccaaccctgcctctggaaacaacttttaaaaacctaaataatatgtaaacagtgccttctttaaacaattgaagagctgagaggggggtaagatgttacctggccaaaataaatggaaaatgaagacgtagggagataaatgagaactggaagctacttttgccatgtgaatatttgccaaatcagaaaattgtaacttttgttctgatagcctcttagggcaagataaatattaaactaaaagccacaatatatacaaagtagagcctttcttcaataaggtggcccccaaaaaggctacaccacagagaatagatgaataggatttggttgagctctcacacataatttcatcttttgttctatttacctaataatccagggaatcccaagccttaaaatttaagatcgtcctcaactgagaataaccccaataacttggcagaggcaaatggaaatcttctctggaggaaagtgacttcatcctatcctaaagtcattgctacagataacaaagtatgatgacaaaaataaccaggtccataaacaaacaagacacaatgggcaagaacaggcagaataataggcaaaaaaaggcacaaaatttcagttaatggaattattaagacacagaccataaaacaactatgcttacaatgtttaaaaacatgaaaaaggcaatcccacttctagtcactctggagaaagagaccaatttgccctcatgcttgaaataaccaaaaactacaaatatatgaaacaacagttattgagttcctggatatcaggttacaagggataataacccttggatatgggcagcagataatgtaataccaacaaatatgtcagcttactgacttaaaatagtttctaggtttccaatgagaacacatggacatagggagaggaacaacatacactggggcctatgggcaggtggggtggggagagggagagcattaggaaaaatagttaatgcttgcttggcttaatacctaggtgatgggatgatctgtgcagcaaaccaccatggcacacatttacctatgtaacaaacctgcacatcctgcacatgtactcctgaactaaaaataaaaaataaataaataaaataacaattctaactagtttccaaaaaggtgaggttaagaatataagacccattttccatgaccccagacttcaaaatgtagtatttaaaagaacttccacttcattttttttttttttttttttgagacagagtctcgctctgttgcccaggctggagtgcagtggcaccatcttggctcattgcaacctccgcctcctgagttcaactgattctcctgtctcagcctcctgagtagctgggattaccggtgcgtgccaccacgcccagctaatttttgtattattattattttttttttagtaaagatggggtttcaccatattggacaggctggtcttgaactcctgacctcaagtgatccacctgcctctgcctcccaaagtgctgggattacaggcatgaaccaccacacctggccaaaattacaaactttgaaataacatagaaatcaaggtagaaactcaaagggaaattagaaaatattttcaatgaaatgaaaataaattaacatgtccaaatttgtggaatgtgaccaaatcagtacgtaagggtaaatttatagcactaaaccacctatgttactaaagactacaggcctcaaatccatgacctcagcttctaacttaagaatgaaaaagatgagcaaattaaactaaaggtaagcagaaggaaggaagtaataaaagtggagttaaagtgaaataaaaagagaaaaacaatagagaaaaaccagtaaaacaaaaaattgattctttaagaaaattaataaaattttaaaacctccaatcaaaataattagaaataaaagagtgaaggcccccaaaaacctatattaggaatgaaagaaaagtcatcaccacagattatgtttattaaaaaataagaggcctggtgcggtggctcacgcctgtaatcccaacattttgggaggctgaggctggtggatcacctgaggttaggggttctagaccagcctgtccaacgtggtgaaaccctgcctgtactaaacatacaaaaattagccgggtgtggtggcggacgcctgtaataccagctatttgggagtctgaggcaagagaattgcttgaacccgggaggctgaggttgcagtgagccgagatcgtgccactgcactccagcctgggcaacaagagtgagactccataaaaaaaaattaatattattaacaactttatttcatatcatatagttaaaaatttaaatgaaatcgataaattctttgaaagacacaagcaccacaaacaaggaaaactctcccaagaatgcatagtcctgtatcttatttatttttatttttatttttattattttttttgagtcaggctctcactctgtcgcccagactggagtgcagtggtgcgatctcggctcaccgcaacctccacctcccaggctcaagcgattttcttgcctcagcctccggagtagctgggattacaggtgcttgccactattgccgggctaatttttgtatttttagtagagacggggtttcaccatgttgtccaggctggtctcgaactcctgacctcaggtgatccacccaccttaccctcccaaagtgctgggattacaggcgtgagccaccatgctcagccatgcatagtcttatatttgttcaagaagttgaatttgtagtttaaagtgttcccacaaagaagactccagacccaaataacttcactgttgaaccctaccaaacatttcaggaataaataataccaattccaaataagtcaagtgaagaggataattcccaactgattctatatgggcagcatcaccttgaaactaaaatatatgtggtattattataagacatactattacaggacaagaaaattaaagatcaatattgctcatgaacatagatgcaaaaattctaaacttctttttaggaaatctaatccaacaaaatatgcaaaggacaatacttcttgaccatgtaatgtttatctcaagaaagcaaggttaagttacaattcaaaagagcagtcaatgtaattcactatgttaacaatctgaataattaaaatcatattatcatttctaatgcagagaatgtatttgaagaaatccagcattcattctttttaaaaagttgtattgataaatgataattgtacatatttatggtgcacatatgatactttgttgcacgtattgaatatgtaatgatcaagtcagggtatttgggatatccatcactttgagtatttatcatttctttgtgttgggaacatttccagttctctcttctagatactttgaaatatatgtccgggtgcggtgtcttatgcctgtaatcccagcactttgtgaggccgaggcaggcgtgtcacctgaggtcgggagttcaagaccagactgaccaagatggagaaatcccatctccactaaaaatacaaaattagcagggcatcttggcacatgcgtgtaatcccagctactcaggaggctgaggcagaagaattgcttgaaccctggaggcagaggttgcggtgagctgagattgcgccattgcactccagcctgggcaaccagatcggcactctgtctcaaaaaaaaaatatatatatatatatatttataatatatatataatattttgttgctaaatatatatatatatataatattttgttgctaactatagtaagcctactctgctatctaacattaaaactaatactttctatctaatatgttttattctattgaccaacctctcttcatccaccctcctacctacataatcttcccagcctctggtatctaccattctactctctatctctatgaggtcaacttgttaagctccagtatgtaagtgagacaatgcaaaatttttctgtgtctagtttatttcatttaacataatgacttccaattccatccatgctgctgcaaataacatgatttcattcttttttatggctgaagagtatttcattgtgtgtatatatactaccttttgtttatccattcgtccattgatggataccagttggttccatatcttagctattgtgaatagtgctgcaataaacaagtgagcgcaggtatccgtttgacatactcacttcttttcctttgaataaatacccagtagtggaattgttagactgtatggtatttccatgtttagtttttgagaaatctccatactgttttccgcagtggtcgtactgatttacatttccattaatagtttctaagagtttcgttttttctgcatcctcaacagcatctgctattttgtccttttaataatagccattctaattagggtaagacgatatctcattgtgattgtgatttgcatttccctgataattcatgattttgattttgagcatttttcacataactgttagccatttgtatttcttcttatgagaaacgtctattcatgtcatttgcccactttttaatgagattttaaaaaattgttgagttgtttgcattccttttatattctgaatattagtccattgttagatgaacagtttacaaatattttctcccactcaacaggttatcccttcactcttgattgattcctttgctgttcagaagctttttagtttaatatagtcccatttgtctagctttgtttttgttgcctctgcttttgagttcttcgctataaaatccttgcctagatcaatgtcctgaagggttttccctaccagcattcattcttgatgaaacctctcaacaaaggaatgaaaaggagcttcttcaacctgatcaaggcttttatgtaaaacttatcatacttaatggtgaacaaatgaatgctttctccctaacatctggaggaaaacaatgatttctatttctaccatttatattctagtgttctgtagattttaaccagtgagacaaggcaaaaaatcaacagaggcattcagatagaaaaggaaaaaataaaattctctttattcacagaggaaatgattttgtagaaattctgatggaatctattttaaaagccccacgtggactaatacgtgagtttagtgaggtagcagtaaaacaaaatcaatatacttttaaaaactattttctttccatatactcacaaaaattgaaataaaaaatggaatatcagttatagtatcatcaaaatatatgaaatacttatgcacgaagttgacagatgatgtccaagacctataaaccataaaatattgcttggaaagattaaaaaagacctaaataaacgaagaaatatactgtgttcatggaaacttttcagtctttcacaactaagtatgatggtagaatggtagacacaagatttttttttttttttggagcaacatgctgtttcaatgagagcctgggtgcaggccggctgaggcctaaaatggcatcagcaccaaatgaggacagggcaggggttttatagtctcctgtaaacaggaagtgtcccagtctgatgtgactgttacgtagcacccggacggcctctttctcaatcttcagggatacgtgtcttccggtcagggtaggtgtcttccggcccgctctcttcctgcttctgctatcttgctgatgcactctgctgatgcaagtggccttgtgccttgggactgggcctgagaagggaggagttactcatcccttcaagcttgcaggccccagggagaatctttaattcttatttggttatagaaaaaagggaaaaggggcgactttctcaataactacttcagacgtgacatagtgggtggcatgggcaccttggaaaaagaaaaccttaattttgggcgtattcttgagagatgggttggtatgcattgtgtcgttgtagcaggagcattgtctggattgtctggcagttaactgtagtttcaacaagagttttaatggcttttattatcagtgggataacacaggggagaaacaggaggagcccagtgatgaagattactgtccttaccagcgttttaatcctcttaaattagagaaccaccctcctagaaggtttgcccggtcccattctttccaggtttggactggcacatgggctacttttcttatatttgaagcgatttctagaactgcttttccgttatcgtctatgttaagacagcaattagagatattaaacttaccacagaccccaccctcttctgctaataagtagtctagtgctagcctgttttgataaattgccacaagcatttggttttgttgttgcgcgagcatttccagggctgaggcggtttggttagtgattatctctagaaccacctgtagtgtaattattctacttagcatatatatgggaatgtgataaccccatgaaccatcctcagctcaagtggcaggtccgtaatattcgatgatatgttgtggaggccatctgtcctcttgccatctttggcttcctcctacctttaaggattgtttttctctgtttaagttcatacacagggactccgagggtgttgcccgctgttaatgttttggaggaaggagtaggcttgggggtgagcttgaccctggtgtgatggaccccgtgcgggagtctttgggctttcactgcagttggcatgctgagtatcacagtgtacgggcctgtccacttcggttgtagcttttattgagggtcgggctggcagataaacacatctgtgcctgcaagacagttatgttgagaggacaaggaggtgtcgacagggagaggcatggcctcatttactgcttcacgaataaaataccgtgtctggattaaggaggggaggtaactcccgagtggctcagagtctgctaagggtgtaggccctaaaacaaaagttcggcaatacatgatttcaaagggactataaaaagagggtggttttggtgttgcgtggagggtaggcacaagattttcatatttccttttgggagttttctgagagttttttttgttttctcatgagttgggggaactgttgccaaattttgacaaatgctttttttgcatctattgagaacaaatggtttttctcattaagtctattaacgtggtgaattacaataattcattttcaaatgccaaattaaattttatttatacaagatgaataagttctagagatctgatgtacagcatggtgactatagttaacaacactgtattgtatacttgatatttcctaagaaggtagagctgaagtgttctcaccataaaatagaaaagaaaatggtgactatgtgaggtggcagacatattaattagcttgattgttgtgatcatttcacaatgtatttcaatatcaatacgtcaatcttcataccttaaaaatacacagtttgggccaggcgcaggagctcatgcttgtaatctcagcactttgggaggctgaggcaagaggattgcttgagcctaggagttcaagagcagcctgggcaacctagtggaaccccatctccacaaaaaatttttaaaaattggcgggtgtggtggtggtgcatgcctgtagtcccatctacagaggctgaggcaggaggaacacctgaacctgggtggtccaggctgcagtgagccatgattgcgccactgcacatctgcctgagtgacaaagaagtctctctctctctctctctcattatcgtataataacaaatatatacaatttgttatttgtcaattatatgtaagtaaagctgagaaaatactaaatattgtatccctggggtaaactccattattcctgatgtattatcttaggctttttctaactttagtactggctttaacattcagatatgaacatgattgataaaattatgttaagggtttttattatcaatttctgatgattgagtgtcttaacacaaataggcattgggtatgtcaaatgctttttttcttcttctacatttatgagaaggatcataaatttttacgaggttctattaaaatgacaaatcattttaaaggctttcctaatattaaaaacccttgcattcctagaataatatgattaatcatgaaatacttttattttgccaccggttttttaaaataacatttaattttttgtgtcaatataagtgagttttgtctataggatttgggttagtttgtttgttttggcatttgtttttgttgttgtaggatcagtgttgcaattactctaaaattaaattttatacgggtatctcagttaacgacagtgccataaatctgaatctctcaacatatcctctaaaaattcaaacataacaaaagaaaaacgaatgaatatacagaaatccacatccatagcataactaaaaacatagaaaatatccaaactttgaaatccgtacttggaaaagtaagcttcaaatctcgtgaactttcttgtaaggactcctatcacatttcttcatggaaaacagtctgggaaatctgattggaagagagaatagaggagccagcagtaggcctaaaattgatctaaaaccaccactagatagagaaatttatcctaagtgcaaatctactataagagtgctagtagattggagttcttatgacaaggaaggggcttaaaggacagataaaatgacaaaaatcaacatccacaacttaattagaagatggacaatgcccaaactttatttaagttaccagtaaatagagtaaatttaagttatttattatttaagttaccagtaaatagaaaattcaacaaatcccagtgagctacctctcaagcactcctgtcacattccttcacagagaacaaggacaatctgggaaaaactacatggagaaagaagtggggaagcatcacacccaagatgaatctaaagtatttgtcacaaagactaagtcatactaagtgtgaaagtaccgaaaatgtcctagaagaccaaacattttactacaagaagagaatttaaaagtgccctaagaccaaaagtcgtcacttctggtagagaagaaggtgaaaaagatgggagaagtaccctttgaagactgggtagtgaagaggaaaggaagcaaaagggcaaaatataggactttgcaaaacaaagaaaacccaaatatgcagaacacacaatccctcctattaccaccaaaaagttaaaaaaaaaaagatgccaagcaaaacattgaaaaataaaactctactctgccaaccaaacagaagagggtgcccttgaactacaaatgttataaactactgcaaattcatgaaatgattaagcaaaaataaagctattataagaaaaaaaagaaaaagagagaaactctgctgatgaaatctccacccccaaaagctatgatggtgaagaaaattaaaataatactcctatgtaagtttcttatgttgttgtaacaaatcacctctagcttactaacacaagttgtttgttggtttaaaataatgcaaatatattatcttacagttttggaggtcagaaatctgaaatggatcttatgggtaaaattgaggttttggtagtcattctgaaggttctagaagagaatccatttccttgttgtttctagcttctagaggctgactgcattcattgtcctttcttccattttcgaagtgtatcagatattaaagggggaacactaactagcaccatgttttgttagattggtgttagaggtattagtatgaagtcatggtgtgatagattaagatgaacagatagatgcacagataaaatgacacaattatagatatggaaagagataagtatatgtatatattatgcatatacatttatatatacatttacatatacacatattgatgtgcatacatgtatatacatgcacatattttctaattctgtctactcagagatcctagaagcagtgacaccacagtagcaataatcatgtttagtgctcggctcttagttgagatcaagtattctccactaagaggaatcaattctttggagaaatggctgatcaaaaagctgagactagacaagtacatgatgaactgtgaacaccatgttgttcagaaaataagaaagtggccaatgaatggtatatacatgtcaaaaggacagagaaaccagattatagtgtgtaccaatgaccaaacgagggacaattagaacatcagtataaattatgacagtaacattataactcatagaaaaaaagaaagcactatactgaaataaagaagaaattttaaaggagaaaaaagtcttccttatagtggtctatgaactaagaatgtagaaagaataatgaacataaaaaaatcaccatttccagccatcatggcaataattgattcaggcaataattaacaatagatgctaaaactggggataaacatttgatgagtaaccaattaattacatagtctcaaagtatctaccacaagatatttattatttacaaaggggaaaactttaacttcacagtgaggaaacctggcagacaccatcttaacaaaaggatcacatcaaatgctaacagcactggtaaagggacaaattgacattttttttgtctcttgatataatgcattgtgaagaacttgtcatttctgtgatattctcgtcaaaaacacataacctgaaaataatcatgaggaaatgtctgacaaaccccaattgagggacattctgcaaaataactgttatgcactcctcataaatgtgaaggtcacgaaagataaagaaaaatgaatgattttttttcaggttaaaagaaactaaagagacatggcaattgaatatgactcatgagccagaattttctttttctatagaagacattattgagataactattaagatttgaataaagtctgtagacaagctaatagtactatgttaatgttaatttcttggtttttgtaattgtgctttggttatgaaagagaataatcatgtttttaggaaatacaaactaccgtgtttgcaacttactttcagtgggtcagaaaactattatacctatatgcagatgaatacatatataaatacacacagagaatgataagcaaatataataaaataactttttggtaaacttgttgaagggagtgaggaaattttttgtactgtgctttcaactctttagtaggtctgaaattaggtttaaaaagtttctacagccaggcacagtggctcatgcctatagtcctagcacttcgggaggctgaggcaggcggatcacctgaggtcaggagttcgataccagcctgaccaacatggtgaaacaccacctctactaaaaatacaaaaaaatgagctgggtgtggtggcgggcgtttgtaatcccagctactcgggaggctgaggcacaattgcttgaacccaggaggtggaggttgcagtgagccgagatcgtgccactacactccagcctgggagacagaacaagactctgtctcaaaaaacaaacaaacaaacaaacaaacgaaaaaagttttcacctctgcactcctgcctggacaacagagtgagaccctgtctctaaaaagaatataattttaaaaaattcatcatgcttaacaaaatgaaagtattattagaactcttaggtgaaaatttcatgagagacaagatatttatacagtgccaaaatttctcctcataaaatagctatcacacaaaggagaaataataccaaggagaaaatacagtaataaccttacagttgagaaactgggcatgcaccaatatataaccgaatgttcaatgttcacgtcattaacagtggaacacaagagtgtcatgtacctcctgatatcatgcaataagggcaaaataacttctgtggtgtcagtatgaaaacctgagtctaattatgagacagtatcatgggaactcaaattgagaggccattctgaaaaataactgacctctattctttaaaaaggtgaaagacggtcaggcttggtgggtcacacctgtaatcccagcactttgggaggacgaggcgggtggatcacttgaggtcaggagtttgagaccagcctggccaacgtggcgaaaccccatctctaccaaaattacaaaaattagctgggtgtggtggcacatgcctgtaatcccagctacgtagggaggctgaggcttgagaattgcttgaacccaggagggggaggttgcaatgagcctagatcatggcacggcactccagcctgggctacagagtgagactccatctcaaacaaaacaaaacaaaacaaaacaaaacaaaacaaaacaaaaaaacagtgaaagtcatgaaagacacagtctgaggaactcagtggataaagagatatgactactaaaagcaatgcatgaccccagaaaataaattttttgtactcttcttgcaacatttctggtgccatgattttagaatagaaagtgtataaattaatctgaaaatgttgtttctttttctaagctctcagattaagtagcattggaataatattatttttgaaggtttcgcagaattctatgaaatctttttagtttggtgccatttattggagggaaatctttatcaaaacttttttttttttttgagatggagtcttgctctgtcgcccgtgctggagtgcagtggtgcaatctcgactgactgcaacctccgcctcctgggttcaagcaacccggagggttttttttgtttttcattttgcctactagactttctgtctctactggagtcagcagggcaagttgaattgttctaaaaattatccacattttcaactttatttgcatagagttgtccaaaacagtttcttttttctggcttaaaacaataaatatttattaatttttaacaattttgtggactggctggctgatttttctggttaggagtacctcagctgatctctgagttctggatggtttgggaaggcctcactcacatatctagtgatctaggatgccttttgaaggacctcagttctcctctacatgacctctttagtagactatttaagaatcattcacataaaaatggcttcagaattgcaaactcaacaagagaaagtgccaatgcataagaattttgaatacatcatatttgttaaagcactggtagccaaagcaagtcacatggtcaaaccctagtccaaggaatggagtaacagactctgccacttgatgaggagagtgggaaagtcatgttgctaagggacatacatttaggaatgggaaaaatttgtggccattttgcaatctatcacatcttgtctacctaagtattgagagccttctttaaagtggatatattctggtggacatttaccatttacgcggaacataattatattcactgcccactgagaggggtccatttacacaccttttctccatacttcctagtcaccagtcttctaatattgctctcttcaagtttctaaccagttgatcaagccatgctaatgtccatgaatagatccatattctaggccatttcttcatcaagtggacacttgaattctgaccagtcatactattttattactgcctttctaagataaccttatgcgaggctgcagtgcaccatccatccacatctggtagctccagcataccatgatgatctacatgtaaaccagttccatttatttcttcccgtgttaactagtcacaggaaactttccctgagggctgaggaaaaagcagtgaagcatgtacagtggaagtctgagccatcttcttaggcagtttactaatgtctttcatatttattcagctttgttcctctatatcattttcattttacaatccaatactgccacatgtatccaatgttatgatttggtggattaacaacactcacttcatgataagaaattcaggttaactagttatttggtgttccataatctgatattcagtctctactggggcacggtaggagtttcttttcttttctttctttctttcttttttttttttgacaaaaggtcttccttttttgctcaggccgaagtgcagtggcatgatcacgactcacagcagcctcaaactccaggcttaagcgatcctcccactttagcctccacagaagctgggaccacaggcatgttccaccatgccaagctaattttatttacttactgtagagacagggtctccctatgttgcccaggctggtctcaaacttctgggctcaagggatcctcccaccttggccttccaaagtgttgggattgcaggcatgagccacctcacccagccaggagttgcttttctaatagttgttagcaaaagagggcatgcctcactcaaaaacccttggagtctgtgcggtagttctccaattgaatcttgccagagactacatagaacatttctgtgtgccatagacactttgacacttctaatatccttggatctgttgaagcataagagtcaaacagtagggcagtttttatcacagcctgtaactgctgcagaaccttttcttccttctagcccatattagttagggttctccagagaaacagaacgaataagatatgtagatatataagaggagatttactatgggaattgggtcacatgattatggaggtcgagaagttccacaatgtatcattggcaagttagagactcaggaaaagcagtggagtaagtcagtttgaatttgaaggcctatgaaccaggagagccaaaagtgtaactcagtccaaggtcaaaggtctgagaacctgtggggtaggttgtggggggaacattgatataaattccagagtctgaaggcccaagaaccatgagctctaatgtctaacagtaggagaagatggatgtcccagtttaagatgcaagagagaattcaccattcttcctctttttcattctattctggccctaaacagatttgatgatgcctgcctacattggtgagggtgaatcttccttattcaatctactgattcaaatgttaatctcttctgtaaacaccctcagaggcacaccccaaaataatgttttaccagctatctgagcatcccttagccccaacaagttgacgcataaaattaaacataataagtccaccctttatcaacttggtacccatacacatctccctcaaccgtacttaatatccaaataatggaaacaatggggatttaattccccctaacatgatacaactatcctacataaagcagcaaacacactaatcccttcctcagtagaggaggtaaagctctgagtgatgattagtcttctcctgatagcccataactcaaatattatgatgtaaaattcacagtacttaaataccaatgtaaagtcaatacatcttgtgttacatgattagggaataagagaggaaaaaagaaagatatttgcttactatatgtatatacacactaatatattcattaacaaaacaaagaggaaacattcataacatggctttactcaaaaatggcaatattatatatgacctggtaaatgagttggagcaggcacaattgaatgtggtgtctgctctctccaatatccaaagaagcctaccaaatattgtactcttttcttagttgtgagtgatgccaatgtgtagcaatttgatttccagactactggactcctaataacttctctaatgagtcaggccacagaatttgatgaggtttatctctcatgctctggcacgcaagtatcttactaaggtatctagagtggcttctactttctgttcgtcagctccattaagcatgatatcatcattgtaagtggattatgcaatgatttgtgtgacatcaggatgattatgactcctctgactatcttgtgaaagagcaagataattgacatagtactgatgtaagaaagaaagaaagcgaagcagtttctccagttctttaaaaggcagactccttattaccttgatagggatgggaggcaaagcatttgctaggtcagtatccacagagtgatgaaggagacattgactttccaggcccagagataaagtgtggtgaagaaagatcatactgaaagagacattctcgctgggtttccaggattagagaggagttcactagttgagaaccacgtgcatcttacaggcactgcgtcaatcctgtgcacagaattggaaaggaatgaggtgtctatgggaacagtaataagtttatgtagatggatcagtaagagttagggcatgcacataggctgggtttatatcttggaatggccctaagaaggcctggagagtcagcccctccttcatcggtagacacacacacacacactttcatgtgcctcctttgcacatcgcttacactttgtacatgactgtacaatgcagcacttttcgtgtggctaaaggtcttgggaagcaggggagagtggcatccctctgggccagcactagagtatactcatgctgatgtctgaatttccccagacattcacataaatacagggtcatcagaggttcacagagcagcctggaacaataaaaaggccacctctactctactatccctcttccctaaaagccccaacagcaattttgtctcctctccaggcctggtatgacccaagctttgtgcctgtacttgctaggggacccaggctcttcttcccagaagtccctctaaaccagtgactttgtctcctaagtgataagatgcatttgagcagccaggcctctcaccataactgacccttctcaatcactaaggacactgttcaccattgcttggtctgaatacttatgtagctagaatctactcactgtcactaaattcaagatgtcaaaggaaatattgtctggaacttcttgtttctgtctttttttccatatgaaaatacgatctctgtccagttacactcccacccccagcctaagcctagagtgaagtggaataaatgcagagaagtggtcctgttttctccacagttcagaaatggaaaattcaatatgtgtttacaatgacagcaaagttaaaatagctcatctcatgcaatgttgccaaatgaaggataacagagacataaacactgtccttaaaaagattcttttagaagaaaagtatgaatcgaatcatttactgaagtactgtttgaacagatggtgtgattaacagctaacatgtaagccatcttgggagtttatggaaaagtaaacgaatgcagctaaaaagaaatcactttattccccaaaaggttctttcattcattttactaagtaaattggaaagcctgggttttgaaggctgcatttccttgggggatgttaggagggagcagaggagagtctcttcagagcaagaccatgttggtgcagggtcaagctctgaactcgcctcctgagggatgagatgatctgaggatctggcccctcccgtcagctggcccttgccaaccactgaggatgctctgttcagcttgcttgtctccagtggcctcacgtgcctgggaggaggggaaaggagttaaggtttgggaatcagttgttcctggccctctctgggcactttgcgtggactgtttcctctgaggctaacatccctggggtcacatgttataaggccaacttacccaacagggaaatggggtttaaaaaggaggaagttgcctactaaggctgcacggacacttctttcgtggagctgccattgaaaccctggtctattgagttccagagctcttaggagaggcagtggattgttgatgaaagagcgtgaaagtctgctctgctagcttgtgccttggggacaaccgctgttcccttatgcaccacagcttctacatctggaggctttgaaatgattttcctttgcaatattgcaaccattgatactgtgtcccctagtaagtgtgattccacttccttcctctgtgtgtgtgtgtttttactgttattatattattattttacaaaacagcctttgagaatattcctctcgccatttggtaaaggaggtgccccttttgagttacatttgaatttcactccaggtctttactaagcagaatgaaaaagcctactgtgttttctgtgttgatatttgacactccttagagaaaggactcctttcttgcatggcatgacctgttgcaacattgctcctggtcaacagaagaaatttctgtcccacctcagatacccatctgctataaatcttggccgtttgcacctcattttatagacacttgaatctgtgtcatcctcaccactcctatcctactactgtatgtttctgcaggcaacaacagtgtcttgggcttcctgagatgccacttgcctaaggccaatgccttatatgtggtaggtgctctttcaaaatttggccaatgtccaaacttgcaacattgttttattgagttcttaatactgtttcattagcacataaagcctgccataattcatcttcaaaggcagccatcttcattcctttccacatggcaccaatattgttttattaatttaccgggtgctaaaaaggtatattctaaacaattcactctgaggatcttttagatttttaaatctttatatttgtttatctccaataatttgtcatgaaagctgacttctggacttacagaccatatgcttctcctaggagaaagagaaatggcaaaatcagcccttcaattcaccatgctggacttttcttttgagtataatccaataaaggaacaataaatgttaataaaggattgtattaatttcttttcagtctataataattttttgtacagttgttacatttagtttccatgaaaactttatagattaacaatcaaatatcattcactattgtttttctttatccataacactaagaaacaaaaaaaataagaaatcaaatgtacctgaaaatcatagagctaaaagagttcttaatgattgtataatgccatgtgggaatggttgagtgggaaagcagatcatatattttctatagtgtgacataatggctatgaaaatatttagacataagaatggggaaagaggccatatgatgatagtggtcatggctaaacagtatgaatctgggtggttttgtccaattgcctatagtttgttgtagttcccacattttctcttttgacaaaacgtttattagaaatagtaattgtgtaatgagatcattttgctttacaaatgagaaaattaaagtccaggtgttttgagaaaaccacctcaagagatctggcctcaggaatttaaaattaaattatactttgaattctgatttaagaaagacagagatttataatttcatttgtcaattcatccaaaaatttgggtgaaataaaaattctgtaaaatttaagagcaggcacacattttaaagtgggaaaacatggttgtacatgaataaggaatatgtttaccaggtttcctctttctttcagatggagtagccatttagactcatcagcttgtggaaatatctcttgccctactccctaatgtcttctgtcagttatctgctcttcccaagtgcccattgccaatagcagcttcagctgtccagggatgctcacaacctctggtgcaaaaggagatttgattgttttcgcaaatggctgtcaacgtgtctgggtatgagttggtttcactaaaggaaacctgaattttttacatgatgagtgttatttctgctaattattaacacctcaaaattagattggcagaagtttcacaccatgttcaaggactacaaaaactggaaggcttaaatgcagacttctctgaggacattgagactggagactaagatcaacaggatgtttccacgtctcagttccaaagagagatttagagggcacaaaggactctaaaagaatgctgttttaagcattgtctgtatattttggatacaagtcttttatgagatatgtcttttgaaagaattctcgtggtctgtggattgtcatttcatcctctaaactgcatcttttgcagagcagacattttcattttaacgaagtgtgatttatcaaatttatctttcatagatcgtgtttttgctgttgtatctaaaaagtcatctccaaaccaaaggccacctaaattttatcctatgttaccttcttgaaattgcagtttaaaaatttaggtctatgatccattttgagttaatttttataaaaggtatcatgtctgtatctagattcattttttttgcatgtggatatccagtagcttgagcaccattcattgaaaagactatcctttctccactgagttacctttgctcttttgtcaaagataagttgaccatatttgtgtaaattcacttctgtgctctgttttattccattgatttctttgtccattcttttgccaataccacactgtctttatcactatagttttataataaatcttgatgtcatatatcagtccttcctttgttcttcttcagtattatgtgggctattctgggtcttttgccttcatatacaaagttagaatcagtttattaacatccacaaaataatatgcttgtattttggttaggattgtattaaacctatagatcaagttgtaagaattgacatcttaataatattgtcttcctatccacgaacatgaaatatttatttatttacttaagttttacagttttgttcaaatgtatgtttcttatacatattttataaaatttacttaagcatttctgtcttttttttggtgctatagtaaatggtgctgtgttcctaatttcagactccaaatgtttattgctggtatgtagaaaaacaattgactcttgtaaattaatttattatcctctaaacttgctataattgcttattagtttaagagatttggggatttttttggagggggtcctaaataggcaaacatatcacctgtggaacaagacagttttatttcttttttccagatctctgtatctttcattttattttcttgtctcagcacaaagtcgagtagcagggatgagatgggacatacatgtcttgttcctaatcccagaaagaaaacatctagtttctcaccatcaattgtgatgttatccgtaagggtttttttgtagatattgtttatcaagttgggaaacttcccttcttttccttgttttctgagaatttttatcatcaataaatgctgtattttatcaaatgctttttttcaatctactgatatgatcatatgatttttttcttctttaccttttgaagtgagcaattatattaattgacgaaccaaccttccttacttggaataaattccacatggttgtgatatataattttttcattcatttgtgatatataactctatatataactcaatattttgttgaggattttggtgtctatactcatggaagatatttgtctgtagtttctctttcttgcgatgtctttggcttagtattagggtaattctgtccttatagagtgagttaagaagtattatctttgcttctattttctgcaagagattatagaaaatttgtatcatttcttctttaaatgtttgatagaattaatctgggaatgatgctttctatttgaggtggttactaattgtttatttaatctatttaatagacataaggctattcagattatgtatttatcctggcgtgagttttcatagatctctgagtctttcaaggaattggcccatttcatctaaattatcaaatttgtaggcacagggatgtttataatattcctttattatccttttaatgtccatagtataagttgtgatggcacctcttttatttacgatattagtaatacacctcttctttctgattttcttggttagccagggttgaggtttatcaatcctgttgatctgttcaaaaaaccagtttttggtttgttgaatttctctattaatttattgttttcaatttaattgatttctactttaatttttatagtttcttttattttgcttacttgagtttaatttgttattcttttttgagtgtcctaggatgaaaagttagattattgattttagatctcacttttctggtatattcatcaacactgtaaattttcatctaaatactgcctttactccattccacacattttgataagttgtattttcatttctagttagttcaaaatatttctaaaatttcttttgagtgttctttgactcatgtactatttagaagtgtgttgtttaatctctaaatattttggaattttctagccatttttctgttattgatttctggttaaattccattgtgttatgacatcatactttgtacaatttctattcttttaaatttgataagttgtgttttctatcttggggaatgtaccatgtgaacttgagaagaacgtgtatcctcctgttgttggatgaaatattctataaatgtcaaatagattgagttgattgatggtgcggctcagttctagtatatccctatggatatttttgcctgctgcatctgtcagttactgatagaggggcattaaagtcttcactataatagtgaatttgtccatttttttcttacaggtctattggttttgccacacatgattttcatgctctattgttaggtgcatgcgtattgagcaacattatgtcttcttggaaaattgattgctttatcactaggtaatactcttttttatacctgatactttttctggttctgtagtctgcttcaagcaaaattaatatagctactctagctttcttttgattattgttagcatagtgtatctttcttcatctcattacttttaatctgtgtctttatatttaaagtgagattttgtagataacatatagttgggttgcatgtttaatccattctgatagtctgtatcttttaattggtgaatttagaccattcatattaaaggtgcatattgatattgtgggataaatatttatcatttttgtaactgttttctatttattgcccttgttctttgtttcttattttatattccactctttttgctttgtttactctgtttttttctaaatgatctactctggttttaattgagcattttaaatgttttcattttctctcctatattagtatttcacttttatctatttttaattttttaatgaataccatagaacttgaaacaaacatttatgactaatctaagtccagtttcaaataacactataccattcacagataaggcagatacctttaacagagtattcccaattattctctcccactcttcataacattgctctcatacatttcacatatctataagctataatctaccatattgttgttcttattattttgaataagctattatctgttagatcagttaagaatgaataaaataacaacacatgctcattaagtttctattcaacaagtgttgaatagaatgtgaagaaattgaaacccttgtgcacttttggtaggaaggaaaaatcatgcagctactatgggaaaatgatatggcagttcctcaaaaaactgaaaatgtaatagccatatatatccagcagttctaccactggtgtttgcccaaaataattgaaagcagggtcttgaagagatatctgtacaccaaggtagatagcagcattatttaaaacagccaaaaggtaggaacaactcaagtccctattgacagatgaatggataaacaaaatgtggtgtgcacataaaatggaatatcattcagcctttaaaaggaaggaaattctgacacatgctacaacatggataatccttgaggacattatgttaaatgaaataagctagtcacaaaaagacaaatactgtataatttctcttatagagctacccagagtattcaaattcatgaagaaagaagtataatgatgattggcaggggctggggggagggaggaacagggaactattgtttaatgggtatagagtttcagttttgcaagatgaaaaaagttttgtagattggttgcacaacaatatgagtgtacctaacactagtgaattgtacacttgaagttaagtgtacaattaagatcataaattttatgtgtgtttttccattaaaagtttgaaaaaaattttaaaagattaagccaaataaaatatttcatttttccttccttcattcattttcaaacaattttttcaaatttgatctataaattagatgccaccccaaacaaaatttcagcagactttttggtaagagatgactaactgattgtaaagttcaatggaaattcaaagtacctaaaatagccaacagaactttgaaaaagaaaaatgtttgagactaacactccctgattttaatatttattttatatctccagtaaacaagatgtgtattaatggtataaaaagcaaatcaatccatgaaagagaagcaaatccagaagtagatccacatacttatattgacaacctattttggacaagggcacagatgcaattcagtggattaatgatagccttttcaagaaatagtggtagaacaattagatattcatatgcaacaaaagagcatcaatccatatcttgcaccatatacaaataattaacagaaaatatgttatagacctaaatgtatcacctaaaactattaatcttctatatataaatacaggagaaaacctctgtgaccttgaattagggaaaactttcttagatacaacaccaaaagcataatccttataacaaactaattaattggatttcaccaacattataaacttctctctttgaaagacacagttaagataaagaaaacataagccacagacagaaaaaagagtaatctgataaagatttattccagaatatataaaggcttacattcctgatatatttatacccagaatacataaattggattaaaattacccaatttttaaaagtaagaaaatatttgaagaggcatttcacccacaaagacaaatgaatggcattaagcacctaaaaatatgttcaaccacgttattcatcaaggaaacgcaaactataaatacagtgtgtgttccactacacacctatttgaatggagaaaatgaaaagattgaccatatcaaatattggcaagaacgtggtgaactggaacccttatacactgtttgtggaaatgtaaaatattacaacgttggaaaactgacagtcttaaaatttaatcatacacttgccataagatctagccattccacacttagatatttacctatgaaaagcaaaaacacatgtttgtacaatgacttgtatatgaatgtttgtagcagctttatttataatagcccaaatttgtaaacagttcaaatgtctatccacatgcacatgtataaactgttccatttatacagtggaatgctactcaggaatgaaaaggagtaaacaatcaatacatgctacaatgtgaataaatttcaaggtagttatattatgtgaaagaagccaggaaaaaaaacatactcactgtcccatttcctttatgtaaaattttaggaaattcaagctaatgtatattaacggaaagcagatatttgattttctggggttaggaggggaaggggaagaatgggaaagagaatattaagaggctcgtggaaactttggagaagtgatggatatattctttgttttgattgtggagataattgcatgggtctgcatatatgtcaacttatcaaactggacacttttaaatatgtgcaattacagcacaacaaagctattccttaaaagaaagaaacaggctgggcgcggtggctcatgcttgtaatcccggcactttggtaggccgaggcgggtggatcaccttaggtcaggagttcgagactagcctgaccaacatggagaaaccccatctctactacaaatacaaaattagctgggcctggtggcgcatgcctgtaatcccatctactcgggaggctgaggcaggagaatcacttgaacttgggaggtggaggttgcagttagctgatattgcaccattgcactccagcatgggcaacaagagcgagactccgtgtcaaaaaaaaaaaaaaaagtaagaaacaattagcataaagcataattgatacaatcccatcttttgttgctggtcacaaggcctaattatagctttcttccttcactacctatctgatgttcctcttacactctgccaaaatcttggctcattgatttctgcttttgtgtgttggagtgatccaaaatttaattctcactcaatctaagacctcagtggtcccatttttacagagttgtcacagtttctcagcaaacatatatttggatatgggagtactaagaggcatcttattaaatctctagggttccatgttattaaatccctagggttccagacatagtactcttgaccctaatctatagtagcaacctaatttctttcttagtaattgagaccaatcaccttgaccagcagtgtaacctccccttctttgcctgttggtttagcagcatgaggtgatcaaaatcctcagagggtagtatcagtttccagttgaacataataatgatcttgatctctcattgaagcataattcctttgctaggatctccaaccactgagaccaaggttgctggcacaagaagcaaaaaattataaaccaattattaggtgtaatagtgagatggccactcttacttccatcctagatgcctgtagtctaaagatggaagaaatggcaacatttattagaccctgacttaaggcatatactgcatcttgtaagatagcaccctaaccttgcaggttatttcaccataaactgcaactaggccttcaaaaagtcatttctctactctatcatttgggtaatggagcaaatcgtaagatcagtgaattctggtggtgtatgtccattgccacactactctcactataaaatgagttctttgatcagaggtaacattgtgtgaaatgccatggcaacaaatatggcatttttaagttcacaactggtggtgaaagccaaagatttgtggtcaattgaaggtcaatgaaggtcaatgaagatacatatccagaatatgtatctatttttgtgaggacatatcactccctctatatgatagagtcaaccttctccagatgactggctagtctccaaagggaatggtgccaaactagggagcaatatttgtccctgctcatataatattaggagctcaacagtgttcgtagcaagatgaaccttgataagaggaagtctttggttttgaccaaaaatatggccttcttcactactgtcattgctgctttatacaatgggtcattgggcaagcttcaggatggcacaggtaaagaagctgactgatagtcacagatcatgtcatcttgtctacctgattattgatattgcagtgcatgccctctggttggcaattagatggggcactaggatcatcacatcctgtccccattcagagaagttcattcatttacctttcctagaaacctcttttttcccaaaatttttaatgttatttttttcaaatccttttccagccatctaatttgttagccatttctcatgaagcagtatagattcatgtctctggccatttgtccttccaaacaatgtggagaagcaaatatactacccacacttctactcactgggaggatttctatttactactgttttatatttttaaaaaataatttcaatatttattatagattaaaaggtatatgtgcaggtttgtcacatgggtatattgcgtgttgctgaggtttggtgtacaaatgatcccatcacccagacagtgaccatagtgtcaataggtggtttttcagaccatggtctcctcccctcgccccatctagtggtccccagggtgtattgttatcatctttgtgtatacgtgtattcaatgtttagcttccacttataagtgagaacatgtggtatatggttttctgttcttgtgttaattcacttaggataatgtccttcagctatatccatgttgttgcaaaggacgtgattctgtttttttatggctatgtagtatttctttctttctttcttttttttttttttttgagatggagcctcactctgttgcccaggctggagtgcagtggcgcaatcttgggtcactgcaacctctgcctcctgggttcaagcgattctcctgtctcagtctcctgagtagctgggattacaggtgcatgccaccatgcccagctaatttttgtatttgtagtagagacgggttttcaccatgttggtcaggctggtcttgaactcctgaccttgtgatccgcctgcctcggcctcccaaagtgctgggattacaggcgtgagccaccgcccctggccactgctatgtagtatttcatactatatatgtaccacattttctttatccaatccaccattgatgggcatataggttgattccatgtctttgctattgtgaataactcttgctttttaggcctgacactgcatggggctatagtgcattgctggtgcctgtatacacaaattcatgggcctggttctggagtggctctgctaagtgcctaacgcttaggcccatgaatttcttgttattgtacctgcttatagggtactcctcatgatgccacaggttttggtagagaaagaggcagccaagcagcacgggtaaatactagaggggtctagccacctgcttgtatggtttccttacaccttctggaactactctcacctgttttatgtactgcatttatattttatagtgaaatggtcctgtgcacattcaatttcttagttcagtggactctataatacccaacacagaatggtgagctggagtcatgtagtcatttgttgccccatagtcaggtatttgtttctaccaggcccagtaacaaatcggaagctgcttttcaaatggagattactttgcagacagaagaaggtatagcccaactccaaactacagaagcctctattgtgattcaactactaggactccataaacttctgtgtttgccacagctacctctaacatcattgggtctattgagtcataggcccaagtggcagggaagcttgcactgcagcttggatttgctgcaaagctttcttccccctactctaaatcctacttaaaattggtatcctaggccaggcgtgatggctcacgcctgtaatcctagcactttgggaggctgaggtgggtggatcacgaggtcaggagattaagaccatcctggctaacatggtgaaacccggtctctactaaaaatacaaaaaattagccgggcgtggcagcgggtgcctgtattcccagctactccagaggctgaggcaggagaatggcatgaacccgggaggtggagcttgcagtaagccgagatagcgccactgcactgcactccagcctgggcaacagagcgagactccatctcaaaaaaaaaaaaaaaaagaaagaaaaaaagaaaaggtatcctactaggttatctggtaaatggattagagtatcacaattaagtgtgatatattttgcctcttccaaaatccaaagaggactattttatcttgtgactctttctttatgatggatatatcatgagtatgtaatgtgacagcaaatttttgcctctcactttatagggtataaccctacatgcccagatcaccatactcttaaaaacatcgccaagttgtttaacagtgtgtagcacctccctgttctatctctccctcctgctgcagccatgtagaaagtgcctgcttcccctttgccttccgccatgattttaagtttactgaggattccccatgcatgcttcctgtagagcctgcagcacagtgagccaatgaaacttttttctttataaattaaaaaaaaaaaaccatcagagtgaacaggcaacctacagaatgggagaaaatttttgcaatctactcatctgacaaagggctaatatccagaatctacaaagaactcaaacaaacttacaagaaaaaaacaaacaaccccatcaaaaagtgggcaaagatatgaacagacacttctcaaaagaagacatttatgtagtcaacagacacatgaaaaaatgctcatcatcactggccatcagagaaattcaaatcaaaaccacaatgagataccatctcacaccagttagaatggcgatcattaaaaagtcaggaaacaacaggtgctggggaggatgtggagaaataggaacacttttacactgttggtgggactgtaaactagttcaaccactgtggaagacagtgtggtgattcctcaaggatctagaactagaaatactatttgacccagccatcccattattgggtatatacccaaaggattataaatcatgctgatataaaggcacatgcacatgtatgtttatggtggcactattcacaatagcaaagatttggaaccaacccaaatgtccatcaatgatagactggattaagaaaatgtggcacatatacaccatggaatactatgcagccataaaaaaggatgagttgatgtcctttgtagggacatggataaagctggaaaccatcattctcagcaaactattgcaaggacaaaaaaccaaacaccgcatgttctcactcataggtgggaattgaccaatgagaacacttggacacaggaaggggaacatcacacaccagggcctgttgtggggtggggggaggggagagggatagcattaggagatatacctaatgtacatgatgagttaatgggtgcagcacaccaacatggtacatgtatacatatgtaacaaacctgcacgttgtgcacatgtaccctagaacgtaaagtatataaaaaaaatcaccagggtcccagacagctgaactttcgcggagtttatctcccacattttgacatctgtgccttagtaagggtatctaaggtaattattacttccgtatcagttcaattagcataattacgtcagtgtaatagaccagtgtaatattttctagaatgttgagataatcaagactcccttggactgattgtattatgacagagcaggaaaatagattttggtcaatgtaagactgagaaggtgtgctgttgacattaacaggtaaagatatactgtttctgatgattttttctgatgggaatttaaaaggatgcatttgcttggtcagtggctgcaaaacaaagtggcagagctgtttcagtttgctacaatctgaagataccatgtctgaaactgcagtggtgaattgcatcacccttttgtttataataatccacagtcttttataatacccacatgacttttgcacttgacaaacaggtaaattaaatgaagttgttataagaatcaacatccatgcattttttgaggccttggtagtggcactgatctctgtagctccccccaaagataaggtattgatttggatttattatttgggtgaggatattgaggggagaaacaagttaataggatcttcactcggccctttctactgcaagagccctcattccatggtgattctgacagtttctaagtatacttattcctgctatatatcaaaggactgggaaaatcattacagagtgcatctgtgggaccaatggatccaacgttaaataaacttgggccagtgctcggtctatcccctgaatttcagaaactaccattctgatcagtaggccatgatggtatttgggatctccaagttaataaacggtacctgatgattcttggaagagctggaaatttctcttttcacagtgcatagtagccctggtaaagggttgcatttctttccgggtgagatttaaaggaagattcactgtacaggcacatcttgtttagtggcgctttgctttactgcactttgcagatactatgtttgctacaaatagaagatttgtggcaaccctgcattggttaagtttactggtgtcatttttcctacagaatgtgctcactttgtgtctctgtgtcacattttggtcattctcacaatatttcaaactgtttcatgattgttatatcttttatggtaatctgtcatcagagatctttcttgttactattataattgttttggggtgccaggcatgcccatataagacactgaagttaatcagtaaatattgtgcttattctgacggctccaccaaccggccattcccccatctctctttctctcctctggcccccttattccctgagataaaacaatattggaattagtccaattaataaccctgcaatggcttctaaatgttcaagtaaaaggaagagttgcacatctttcactttaaatcaaaagctagaaatgattaagcttagtgaggaaagcaggtcaaaagctgagacaggctgggagctgggcctcttgtgccaaaacagcagcagggtttgagaggattgactccagtcttgaaggaagttctactgtgtgtaacatgctattaaacagcatcacatgctatagagaaatctttcatgaaaggaagggtcaatcgatgtggcaaacttcattgttgtcttattttgagaaattgccacagccaccctaccctgatcagttagcagccatccacattgaggcaagaccctctgccaacatgaagatgacgacttgctgaaggctcagatgatcattagcatttttagcaatagagtatttttaaattaaggtatgtacattgatttttaaagacataatgttattacacacttaatagactaaagtatactttaaacataacttttatatgcactgggaagccaaaaagtatgtgtgacttgccacattgatatattaactgttttatagtgttctggaactgtacacgccctgtctccggcatatacctgtatagacttgtggttgcattgtaagattcttccaaaaagaggcattgcctcccctacaatcaaggatctctaggcctgtaaaaaggaataggctgggaaccaaataagagaccattatgatttcttactatggcaacttgagtcaggtttctactaaaatgtttcctcttgcacagattaattgcaccttagtaggctacctatctcattcatttctctgaatcttgtgattaattagctaccacaccgatcactgcaggccagaaaacattctatatgtgccttattgtggtaatttggccatcttgtcaatgatggttaagcacaccacctggccacacttctctgggatataattattattgttcaaagctgggctcccaattccatgttgataactaccacaataaccttgggatatggagggaaaccaccatagatctttcttagcacggattttgtaatgccttcgtgaagacactgtcttctggtctctcccaaaggctgtagttaaggcgtgactgagcaagttacgtgaaacagatctgtgactttcccatctttcttcttaaatctttgtgttcctttcttaaaactatactaagaaagtctgataccttaacccagttgactgtatgctacaattgattttaaataaccaagtcaaaagacagttagcaatactcccaagtgctcaagttaacaaattaaatccagaatttcagataaatacacccatatcaataaattcaaccaaatacaatttcatgtttttccttgttggtctaatactctttgtatacatttccatatctgcccttcaaattcctgctgacataaattagcaaaccttgcaactcttttaacacatacattatctcctccctgatcacatcttgcatttcttctgtggtatattgggacctaattttaaatcctacattcaataaaggatactgacaatagattctgagaagaataaatattttttgtgaggcaacttcctcaggtgaagacattgaaaagacttcatgcaaaggaagaatggcaccctcacattaatgggttggggtggattgctactgcttctggatctgcccaaatgtcctcatcccacagcttatggtcccacacttttcctactattgcccttaacctagcataacttggtgaggttgtgacagtgctacaacttttgaattcttacaatcaggcctttgtcctgcttctcagccatgtctgcccttaatataggtaggttaatgaagggattctagttaagactgccagagactctgattctccattctctgctttgatttgagaatttaaggtattaggtttatcttttcgtcctacttctctgaacactcattcatgttctccttcagatgctttcctcctcaatatagtcattaaacattggagttactcaagacttgctactgggccctctcctcttcacattgtattctctctctttgagaaagtatccatttccagtagtttcaatgatcatttgatgtctgtaggcacctcaaaatctacatgtacaaaatgtaaccattactcctttaatatttgctcttccccttatgtttcttatttcagtgaatggcactgcaacccacacagttgacaatggcaaaatctttgatatcgcttccaatttctcactctcaatcatgaccacccacatccaacttatcaataattattgtaaactgtatgtcctaaaattttacaaaaaactacattctagacaaaaaaaacctccaggaaggtaggaagagtatatttttctctactgtttcatcaccatgtggcatgtagtaggttgctgataaatattgctgtattaatgaatcaatccataattgaacaaatgaatgagtatgcacttttctcctcattttctttgctactattctacttcaggttaccattacttctcacctgacttaccacaatgccttcttaactggtctctctaactttagtcatctgtgctttcatctatccatcatgctgtagtcagatttacctctccattcaggccatctctttgtgtaaaagctttcaatatcttaaagatgtaatagttgcatttttctctattccccctactaagtacaatgaaaagccctgggcaatatgtataaaataaacgtacaaagatgctcaaaggcgaagagaagaaggcagatcagctagggaccttgacatgcaaagaatgacaaggtggtgacttctctgagttttctttttgcttcatatatacaagtctgattatggagaagctggtaactaggaaacactaatgggatgcagacagaaaaaaaaaaagccgtaacaaaagcctgttctctctaatcaaaaacccaggaaagggacgggttagcaagagagaaagcttttagaaaataactgctttactgcagccaaacaccacatttaaaaccatggctccaatcccaaatcatgccagcagaagccacatggggatctaagacttccacccacaccatgctgtcatgaggtgccccaaatccacacatccccaccactgctggaatggtgtcagaggaggcttagtggagagagagagagagacaggattttttttttaaattgagacagggtctcgctctgctacccaggctgctggagtgcagtggtggaatcacggctcactgcaacctccacctctagggctcaagtcatcctcccacctcagcctcccgagtagctgggactacagatgcacaccaccacaccaggttaatttttgtattttttgtagagatggggttttgccatgttgcccaggctggtctctcaaactcctgggctcaagcaatctgctcacctcagcctcccaaagtgttgggattacaggcgtgagccacttcgcccagccaagagtcgggtctctccccatcactcagtgataacaatgcgaacttcctttcctctccacaaagtgtcagtggaggtcatgtgaggagcagtaatgaaacaccctactcctcccattcagggacttttcagtggaagcctagaggacagatagaaattccacctctgcccagcagtagtgaaaaggcccccttgggtattgtagaaggttaaatggggaaactagacttctacctccacctgtcagtaaagatgatgtactccctcccgtctgcctccagagcagtgtaaaaaaataaaaaaccagttaaacacaagatttagaaaagatccacagtctcatcataatagtcaaactgcataagtttaaataaaaaaatcactctgcataccaggagctagaaaggtctcaaacagaatgaaaagagataatcaatagctgccaatacagagataaaaaagatgttagatatatatgacaatgattttaaagcaactatcataagatgcttcaatgagcaatcacaaatatgctggaaaccagtgaaaaaatagaatttcagcaaagaaacataaaatgtagagaagaactaaatcgaaattctagaactggaaaatataacaacaacaacaacaacaacaaaaacactgaaaggatgagctcaacagaagaatggagagggcaaaaggatcagtgagtttgaagataggacaatagaaattatctaatctgaacagcaataaaaataccaaataaatcaggcacagaaagatgaataccacacattcatacatatgtggaggcttaaaaagttggtctcatagacagagagagtagaatagtggttactagagactgggaaggtgtggggaggatagccagaggtaaggtgggttaatggatacaaaatcacagctagatgggaggaataagttctagcattctataacactgcagggtaattataattaacaatttattggatattttcaaatagctagaagagcaaattttgaatgttcctgacaccagttaccctgattttatcattgtacattgtatacatgtatgaaaatatcatgcgtaccccataaatatgtacaattattatgtatcaattaaaaataataatataaggaaaaatagactaaaaaatgaatagactgagggatctctggaattataacaaaagatctaacattcttctccttcttttctccttctccttctccttatacttcttcttttgagatagggtatcactctgtcgcccaggctggagtgcagtggcacaatcttggctcactgcaacctattcctcctgggctcaagatatcctccaacctcggcctcctaagtggctggaactacaggtgtgtgccaccacaccaggctaatttttgtattttttatagagacagattcactatgttgcccaggctggccttgagctcctgggctcaagtaggccacctgccttggtttcccaaagtgctgagattactggtgtgagctgctgcacctggccaatctaacattcttataatcagagttctggaagtagagaaggagggcggggacaaaaaagtactcaaaacaataatagctaaaaatttcctaaatttggcagccatgaatctacagatttaagaagctgggcaaacctcaaacaggataaacacaaagaaagccatacaaagacacatcataggccgggcgcggtggctcacgcctgtaatcccagcactttgggaggccgaggcgggcggatcacgaggtcaggagatcgagaccatcccggctaaaacggtgaaaccccgtctccactaaaaatacaaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaagacacatcatattcaaacttctgaaaactaacggcaaaaattcttgaaaggagctaaagaaaaacaacatattacagggaaacaataatttcaatagcagcagatttctcatcagaaaccataaaggccaaaaggaagtagtatattttttgattgctgaaagataataatgccaaatgagaatcctatatccagtgaaaatatccttaatgaattaagaggaaaatcaacatattcttgggtgaaggaaatctaagaaaacttgtcaccagcagagctatcctaaaacaatggctaaaggaagttctctaaactaaaaggaaacaataaaaaaaaaaaaggaatctgggaacactaggaagaaagaacatggtaagcaaaatatatggataaacacaataggcttttctcctcttgagtcctctaagttaagtctaacggttgaagcagaaattatgacattgactggttacaaatgtatgttggggaactatttaagacaattaatttataaaagtagaagggtaaacaaatgtaaagagaggtaagatttctacacttcactcaaattcttaaataacagcaatagactgtgacaagttatatatatgtaatgtaatgcctagaacctctttaaaagctatggaaagagataatattcaaaattgctagaggtaaatcaaaatgatattaaaaaaactaagtacactcaggaaagcagaaaaggaaaacaggaacacaaaaaacagagggtacaaacaaagataatgacaataatactttttaaaataccaaacttaagttccaatagatcaatatttgcatcgaatgtaagtgatctaaacacaccaattaaagacagagattggtgaagtggatacaaaaatatgacctaaactatacattgtctaaaagacacttactttaaacaaggatatagacaaattgaaggtaaaaggatataggcaaattgaaggaaaatacatatcaggaaaatgttaaacaaaatatggtagagtgggtatattcatattagatattagagcaaagaaaattaccagagatagagaagaatgttataaaaagggcaagttcaccaagaagatatagcaattctaaatgcaccaaagagaattgtaaagtatgtgaaacaaaaactgatatactcgagaccaacagagaattccacaatgattgttggagacttcaatatccttctctcagcaattgatagaacaactatgcgcacacacaaaaatcaccaagaatataaaagaactcaacaaccccgtcaaccaagaggatctaatcaaaatttataaaaccacttcaccaaacaaaaacagaatacacatttcttacaagtgcccactgaacatataccaagatacaccatacccaaacccataatataagtttcaacaaattcttaaaaaattgaaatcatacaagtggttctccaaccaaaataaaatcaaaatagaaatcaacaacagaaaaacaataggaaaatcaccaaacacttgaaaactaaacaacacactttattttttccttttgttatttttcaatcttttagtttagttttaggggtacatgtgcaggtttgttatataggtaaattgagtcttgcaggggtttaatgtacagattatttcatcacctaggtaataagcatagtatctgataggtagtttttttgatactcaccctcctcccatgctccacccccaaggaggccctggtgtctattgtactctttttttgtgtccatgtatactcaatgtttagctcccacttataaatgagaacatgcagtatttggttttctgttctgcattagtttgcttagcataatggcctccagtgctatccatgttgctgcaaaagacatgatctcattcttttttatggctgcatagtattccatggtgtacatgtgtattttctttatccattctaccatcgctgggtatttaggatgattccatgtctttgctattgtgaatagtgctgtgatgaacatatgcaaacatatgactttatggtagaacaattcatattcctttgggtatatacccaatggattgctgggtaaaatattagctctgctctaagttctttgagtaatctccaaactgctttccacagtggctgaagtaatttacattcccaccagcagtgtataagtattcctttctctgcaactttgccagcatctgttattttttctttttactttttaataatggccatactaactggtataagatggtatgtcattgtggttttgagttgtatttctctaatgattagtgatgctgagtgtactttcatatgcttactggccatgtatatatcttcttttgaaaactgcttatgtcctttgtccactttgttatagggttgtttgctttttggttgtaaatttgtttaagttccttatagattctggagattagctgtttgttaggtgcatagtttgcaaatattttctcccattctgtaggttgtctgttgactttgttagttttttttgctttgcagatgctctttagtttaattagttcccatttgtcaattttcgtttttgttataattgccttgggcatctttgtcatgaaatctttgtcagggcctatgtccataatggtatcttctaggtttccttcaagggttttttatagctttaggttttatgcttaagccttcaatccatcttgagttgatttttgtgtatgataaaaggaaggggtccagtttcaatcttctgcatatggctagccagttatcccagcaacatttactaaagagggaatcctttccccattgcttgtttttgtcaacttcattaaaaaatcagatagttgtaggtgagcagctttatttctgggctgtctattctgttccattggtccatgtgtctgtttttgtaccagtaccatgctgttttggttactgtagccttgtagtatagtttgaagttgggtaatgtgatacctgcagctttgttttcttttgcttaggattgctttggctatttgggctctgtattttcacactactataaagaatatctgagactgggtattttgtaaagaaaagaggtttatttaactcacagttccacatgcctgaggaggcctcaggaatcttacaatcatggcagaagatgaaagggaaagcaaggaccttcttcacatggcagcaggacagagagagagcaagtgaagcagaagtgccacatttttaaaccatcagatcttgtaagaactcactcactctcacaagaacagcatgggggacactgcccccataatctaatgacctcctactagttccctctctcgacacgtggggattaaaatttgagatgagatttgggtgtggacacagagtcaaactatatcaggctattttttggtttcgtatgaattttagaacagtttttctaattctgtgaagaatgtcactggtagtttgacaggaatagcattgaatctgtaaattgctttgggcagtattgtcattttaacaatatcggttcttcatatgcatgagcatgggatgtatttctatttgtgtcatctatgattttgttcagcagtgttttgtaattcttgtagagatctttcacccccctggttagctgtattcctaggtattttacttatttattttgaacacagtttaaataatccacgagttaaagaggaaatcttaaaggaaataaaaatataattgcgccaatgcaaatgaaaatgcaacatatcaaaatttgtaggaagcagctaaagcagtgctgagagtgaaatttatgaaatgaagcacagatataagaaaggaggaaaagtctgaaatcaattctataggctcatatttccagaatctagaaaaagaggagcaacaaactcagtgtaagcaccaggaagaaaacaaaaaagataaaaacacagattagtaaagttggaatcagaaaacagtagaaagctgggtgcagtgacttgagcctgtaattcgagtactttgggaagccggggcaggaggatcgcataaggatttcaagaccagcctgggcggcatagtgaaactccatgtccacaaaattaaaaaaaaaatagccaggcatgatggcatgtgcttgttgttccagctacttagaacgctgaggagggagaatccctcaagttgaggaggttgtgctgcagtgagctatgatcgtgccactgcactccagcctgggtgacagagtgataccctgtaaaaaaaaaaaaaaaaaaaagaaagaaagaaagaaagaaaataacagaaaaaaatcaacaaatcaatgagacaaagaactggttctttgtaaagaaccatcttctaccaaagatgacaaacaaataagagaaaagatacagattaccaactgcaggaagtaaacagtcacttatcactaaaaatcctcagacatcaaaataagggataacttatgaacaactccatactaatatatttaacaagttagatgaaatggaccaattcttcaaaataacctcgcaagctattctaattcatccaatatgaaatcactcatttgaatagacctataattattaaaataattgattttataattttaaaattaagttcccaatcaagaaatctgcactcccagatggtttcactggagaactctgccaaagtttaaagaaatatttacatcaaatttccacattctcttacagaaaatagaagagtagggaacacttttatattcattttatgaatctaatattactctaataccataaatcacataaagagagtaagaaaccctacacaccaatagatgcaaacatcattagcaaaatattaacaaagagaattcagtagaatataaaagaattatacaccatgaccaagtacagtttatttcaagaatacaaggctggttcaatatttaaaattctatcaatgttatgtctatccatcatattaacaaatgaaagaaaaaaatgatatgacctcatcagtcgatgcagaaaagatatttgatgaaattcaacactaatttatgatttttaaaactcacaaaaatagaatttgaaagggatttcctcaactcagtaaaaaaatctatgaaaaatgaactattaacattatacttaacggtgaaagactgaatcctctcaccttaaaactgggaaaaaggcaaggatgcctattctcaccatccttattcaacatagttctggaaattcctgccagtgcaatacagctagaaaagaaaataaaagacatgtagatcagaaaggaataaataaaactatttttatttgaagatatgattatctaaatagaaaattacaaggaaactataaaatgacaataaaacaacaacaaatgaacaaatttctagaacaaataagtgatttcagcatcaaaatgtggacatttaagattaaaatttaatactatttgtaatcattcaaaaagtgaaatacataggcataaacttaacaaaatacagaaaggaatgtacataatgtcaacaaaagaaataaaataagatgtaaataaatggagatgcatatatgttcatggattggaaaagttaacatagaaaagatgtcagttttttccaaacttatttaacacaattcctatcaaaatcccagcaagatttttttgtagatatacacaagattattataaaatctacatggaaagggaaaggaattacaatcgcttaaacaatattttaaaagaagagaaaaggtagaggaaccagtctactaatttcaaaacttatatacctacagtaaccatgactgtgtggtcttagccaaggttaagacacagagatcaacaaaatagaacaggcaatccagaaatagaaccacatgtatatacccagttgatttttgataaagatgcaaaaggaattcaatataggaaagatagccttttcacaaaaggattctggataatttggggacatccatgtgcaacaaaatgaactttaacataattccctcaccttattaaaaaactaactgaagatggataatggacataaacataaaatataaaactaaaacccttattattaaaaaatagaaaatcaccaagatcaagagataaatacagactttctagacttgacttgaaaagcaagagctatgacaggaaaaattgataaatagaactacatcaaaatttaaaattttggtttttgaaagagtctgttaagaggatgaaaaaagaaactataaaatgggagaaaatatttctaagctaaatatccaacataaagcagttccaaaaggttacataccgttcgatttcatttatataaaaaaccaaaaagacaaaattgtagaaatggagaatatattagtggtggctagggtttgaggagctggggagaaagagggatgtggaggcggctataaaagggcaaaatgcgggatccatgtggtgatgaaaggttctttgtctttactttatcaaggtcaatatcttgattgtggtaacgtattaaagttttgtaagattttacctttggggaaactgggtaaaaggcatagaaggtctctctgtattatctcttataactgcatgtgagcctacatttatatcaaaatagaaattaaattttaaaatactatttttttttaagttcactgttttttcccttttgctcctaagggaaagactaatacagtagcctgccctgtaatgtcctgcattttctgacctctgcctacttgtctagcttcatcatttgccatttcctctctctcactcagtcactctgaatgtgttttttcagttccaggagttcaacatggttttcccctgtccaggactatttatcaagttcttctttctacctggatcatttccccctccccttcttaacttgtttgactcccattcatcttgtaggtttcaggctagatgtcactcttgttgggagcttttaattactcaacacatcccaaatctgggttagctgtccctcctctaattcccaacagcatgctgtgcttgccactaccatactactcactgtactcttttgtaaatatcaacttgtcagactcaggctcagtctttttcattggaccacaatcttcatgagagcaataattatgtctatattgttaatcagtgcataccttgcacctagcacagcacatggcacatagtggggtactcaataaatcttttatttgaatgaatgaatgaatgaatgaatgaacgaagcaagcctcagtcccaaattactagtactaaaacatggtccctcctaaacactctgttgctgtagccaaaactcccttccatctttcctcttcctcctctgctcacatccatctgtcaaaacatcctatggctctagcttaattttctcactatctctattactatcaccatatgccaaaccaccactgtctctttattgaactactgtaagaacttctgggctggtcttactctttaccatcctaactcattgccatagccaggctctatgtgatctttcctcagaaaatttacacatcttctctgtgcaaggcagaaagattggaatacacacacacacacacacacacacacacacactataaatacacatatatatgtatagatagatagttttttttaacacaagggacttaaaaccctatatatattatggaagctaaacttgagtctcttaaaaagagaatgaaaattaattaggtctgtaaattcaagttgcatgaaattcaaaatgtataaaacatatagagtccaaattagttttcattacacagggtctaaaatccctcattaaaaaaagataaatattctaacagttgagctaacacaatcatactttggggaaaatctgattgattaatataatactacattctagggattcagaagctttacaagttgagcaagtttaggccagcatattatggtgggcctctagatcttttaaaatccttaattcaggagacaccaagagaggtgatgtcaacaagaaggcggaacagaaatttccaatgcttatccactcacagaaacatcaattcaaataaccatccacgcacgaaaataccatcacaagagctaaggaatccaggtgagagattgctgcacctcagtggagcacaaaaataacaaaagatgtattgaataggctagaaaagatagtttcattttacttgcattgcctttcttccaagcccacacagcaatatgcagtgcaagatactctgtgtgttagcgaagcagagtgaagtgtgcaccagattttactgcagatcccagcaccagacccaccccagtgaactctggtgccagaccagcccccatggactcaggctgcaggcctgaatctatgaaccccagtgattggacccaaattctaggcccaccccagtggccccaagctccacaccagcccctgtggacccaggcacaacatcagaccacctgaggaccctatcaatcagcccaccgagaatctctggatgggctttccctgtcaacatcagtctgtataactggatgaggtgcctacttcaaatgagcagacaccaaatgcaaggctacaaggatcataaattactttctcttctgtgttctttgagaatattcggactcttgtaactcttgtcaggcctgtctcaatgcagggcataatagcagcaacatcaatgccaaggctttgtagaaaactgggaccaaaatggatttaggaatacacaatatggaaaggatagtctcttcgataaatggtgctgggaaactggatatccacatgcaggggacgaaattagacccttatataataccaaatgcaaaagtcaactcgaaatggattaaatacttataggttagacctgacactgtaaatctactagaagaaaacaaaggtggaaagctcaatgacattggtctgggcaatgatcttttggatagaaccccaaaagcacagacaacaaaagcgaaaacagacaaatggggttacatcaaactaaagagcttctacacagcaaagaaaacaatcaatggagagaacagacaacccaagaagtgggagaaaatatttgcaaatcgtagatttgatgagaggctaacatccaaaatatataaggaattcaaataactcaagagcaagaaaaccaacaacccaatttttaaaatgggcaaaggacttgaacagacatttctcaaaagaagacatataaattcttagcatcactaatcatcagggaaatgcaaatcaagaccataataagatattatctctcacctgttagaatggcaaaaaatcaagatagcaagcattgacagttatgtggagaaaagagaaactttgtacactgttggcaggaacgtaaattggtacagccattatggaaaacagtatggaggtttctcaaaaacctaaaagtaaaattacaatattatccagcaatcccacttctgggtatatgtccaaaggaaatgaaatcagtatgtcaaagagataactgcactcccatgtttattgcaatactattcacaatagccaagatatggaatcaacttaagtgtctatcaatggatggattgataaagaaaacatggtatacatgtacaatgaaatagccttcagcttcaataaaggagaaagttctgttatttgagacaagatggatgaacctggtggacattatgctaagcgaaataatccaggcaaaaaaggacaaatattgtatgatctcagttacatgtggaatctaaaatagtgaaactcatagaagcagagagtagaatgaaggttgctaaaggacagaagatatgggaaatggggagatgttggtcaaaatttataaagtttaagttttgtgagataaataagttctgtagatctaatgtacaacatggtggttataattaataatactgtgctgcatgcttgaaatatgttcagggtatatcttaaatattctcacaacaaataaaaggtaactatgggaagtgatgggcatattaattagtttgaccataataatcatttcacaatgtctatgtatataaaaacatggcattgcacaccttgtgtacaatttttattggtcaattatagctcaatgaagctggaaaaaataaaattattaattcaggtcctcatatcactactttaaacacttaactatctcccagaggagagaataaatgaaaaattgcccacatggagaggacatgaacagatagatgcttctcaaaagaagacattcatgaggccaacaaacatgaaagaaaaaaagctcatcatcactgatcattagaaaaatgcagatcaaaaccataatgagatatgatctcacactagtcagaatggcaattattaaaaagtcaagaaacaacagatgctggtgaggttgcggagaaatagaaatatctgtacactgctgttcagaatgtaaattagttcaaacattgtggaagacagtgtggtgattcctcaaagacctagaagcagaaataccatctgacccagcaatctcattactgggtatacacccaaaggaatataaatcattctattataaagacacatgcatgcatatgttcattgcagcactatccacaatagcaaagacatggaatcaatccaaatggccatcaatgacagactggataaagaaaatgtggtacatatacaccatggaatactatgcagccataaaaaggaatgagatcatgtcctttacaggaacatggatggggttgggagccattatcctaagcaaactaatgcaggaacagaaaaccaaacaccacatgttctcatttataagtgggaactgaacaaggagaacacatggaaacggtgggggtggggatgaacacactctcgggcctgtcgggggtgggacatggggtgggagagcataaggaaatatagctaatggatgttgggcttaatacctagatgatgggatgatctgtgcagcaaaccaccatggcacacgtttacctatgtaacaaaccttcacaccctgcacatgaaccctggaacttgaaataaaagttgaagaaaagaaaaattgcccacatggaaaaaaaattctcttagatcagatcttgtttccccagagtcattgctgaagtaacaattcttggaaatccttatcaaatacattgacatgaaaatgaacattacttttcattagccaaatataaaaactgtctacttttccattagaattgtattcttctctctgcctcccgcccccgccctaacacaaatccctatttttttaggcaactcaattgcaaatcagggacatgttcctttatgttcctaaagtggaaacagtactttgagactggggttataaatatttaaatcaccacaagattttccatagttgcatttgaattgtggattctttttaatctggttaaatattttgggtcggtcagtaaactatacatttttggcaaaggcaaatatatttaaaatttctacatataatcaaatagtcctttccttaatttatttttctgtggctgggatcaaggcaacaatatctttaccactgcaagcagaaatattattttaatatttgtacagagaaaggaaaactgcatgtcatgaattgggcatctatattatcatcatggatgttagaaaatgaattccctttggtggttttctgacaccagtgtttaacggtagctttattataagccatctctgtgtaaataaaggaaaaacatatttaaacaagtagaaataaatgtgcatgattcaccagcacagttaactcaagattttccagacttacaaccacaactgataggaagatttatcaccacagctgcctgtgttaaacttcttttccttgcagttgaaggaatcaaatttcttctttgggattagtcatttgtgggggtgtcaccaactgcaaaatacttctgttttgaatgaggtgcacttctctgttgctgtgcttcagccctaatttttcaccccctttttgggtctttctcttttacatacagacaaattttaatgacttacacagtcaagttttctttagttgttattcagacttaaaactccaggttgcctggtttgatggtaatgtggttacctttcaaggaaggatgggatgaaatgacattttgacctatgttcacaaagatgaaatctgggcaaaagagaaattatccatggagtgtgaaaacgggaagggagcaaacatttcttgggtggctataaatgtgccaagcactgtgctaggctctctgttgaaattatctcatcttggagcagtcctgcaagaggctaaggtgatattcctgtttcacatctgagaaaattggctttctatgattgtgcagcttattagaaggtgagcagataaaagaacccagactcagtcaagtgcagcagctcacatctatattctcagtactttagcaggtcaaggtgggaggatcgtttgagcccaggagtttgagaccagcccgggcaacatggtgagaccctcctctctacaaaaaaaacattaacattagccaggcatgatggcatggcctgtagtcctagctacttgggagatgaaaggctcacttgagcctgggaagtcaaggctgtagtgagctgtgatcacgtcactgcactccagcctggacagcagagggagatcctgtctcaaaaaacaaaacaaaacaaaacaaaacccaaaacaacaatgacaacaaaaactcagacacaaataactctaaatctcttatgtgtttttttctccatttggctatatagcctctagtgtcctggaatacagttaaacaatacattttgttatgaatatacaagttagagagattttaaagtaacagctttactaggaaataattcacataccatacaattcaccctttaaaattgtacaatttaatggctttttgtattttcacagttgtgcaactattaccacagtaaattttagattttcatcacctcaaaaagaagccctgtgcactttagctattacctgcatatcaccatatcccccactagccctcagataccactaatctaattactgtccctatagatttgcctcttataaggacaattcatataaacgaaatcatacaatatgcatctttcatggctggcctcttagcatgttttcaaagttcatccattgctactctatggcatatattaatacttcattcttttctatggctgaataacatttcattgtatgtatatatcgtgttttatttatctaccacttataaagatttgatgttatgtttgaaaaagaaaattctaaagctgaaagagtcctcaatggttcacctattattttatctacctcaatcatgcaacagttattgggtttgtcatacttttttctaagggctccagggaacatgcatcctgaaactcgactagtattacttcataatttctggtaagctttgactttgtggaaccattttgattaatcagattttgtttgggcctatatggaggtggaggacctaaacctgttaagtatctgtcaattgaagaacaatgacagaacagtcgagcaacgagtgagatttcagtaaatccactagatgttggctttacttcatgccacttttactagtttggttttcatcgaattgcctggttgttttagcatcatatagtctaatttagcatattaggttgtatctaaaatgacagatggaacagcccgttaaaaagcaaaataaatttatggccattcacatggcatcataactgtttgattttaaatttatcaaaaaagtacaaagtgtctagccaatttgcttaaaaactggcaaaaattatttatgaggagatacagcataaatgcaaaaataagccactacttctttctgtcaaagcttcagtcaatcacccagttacgttatttatgagattaatagactatttaattataagtttgactattgaccagaaatggaccagaatcattgacgtaatataacctaatataagcacctttcttcaggatccagtaggctacacaactttatcagccttcctttgcctttataggtcctaaataaaaagagaagaaggctcatatttaagcagttgtacaaatgtacggtagagtctaatacatttgtacaaactctacaaagtcatggctagagttgaacaaggatttctttagcatttatcttgattaattatagaatataagcattttgggaaccactttaagctctaaaaacacaagtgtgttcaaaaataagtatacaaagagagtagtactaactagaaccaccatagcagctccttgggagaggttcttttttagggtaacaacagcaatttttttgtgacctacgctttgttggtacttgtcacacaagatgaatggaattaatacacaagatagggtttatgcaactatcatctaagaattcctcctcagatctcattttacaggcaaacaccttctttgaactaatgtgcaacagaccctcaaattccatgttaaggtgattccatctcatgataaaaattctctttcatatggaaaatactttatcattttagaagtattattgcataaattattattccttatactcataatttcttcttttaaagcgttttatgtatcataataaatgttttttcaacatcatttctgtaagtattggatttccgtcacatcaatttctcataaaaaggataaactggaaaaagaataaattattattctttcccatctcctgtttcattgctttgtcttccatggtgtactttaacaacccatctggccatttttactcccaatccttacacacatttttgagcttagcatatgtgttctccctgaaaatcatggccaagattgtgattgtttttctccttcttccccatgagaccccatatacattatgtaacttatctaatccttctcattgccgtcttggccaactagttcccaaagtcttctaacacagcacgtttatagggtacctgtaactaggtctcttcctcttctgtcctatccttctttctcctacactaatccagtgttttcttgagtcgatgctgtctctcttgatcaaaacttttcaatccttatcttgattcccctttgtagattttcatgcctttctcagctctactttgcaaaatctcctctttttgggttttgggtatacagggggaagcatgaagaataattcccaggtgataaagataaggagagtgatgccataatgaggcatggaatacttactcaaatgtgttctgatttagccaacatgtttgcctggagttctggagagaggcctaagctgctcatataaatttggaaggaaagagaagaggatggaaccacagaatcttggtaaacatcaacatttatgggacaggcggaagacctacttcagaaagcagtatgaataaaggtggttagagacataggaggaaagattttgccttttcagtaaggcctttcctgatgacttatttaaaatttgtaactctctccctggcattcttgtcattggtgatttggaaagatggtttcaaagatgtatggggtaaaatagatttctgtgaggtgtgaatcaaatactggcgaagaagaacaaatagctaatgtagttctcttggatataaaacagaagaagttacaggatctgttagagggtgatatgggggacttttaaagataggagagaatggagaaatttatggggtagggaccaaaaatcaatagattcaaagcttattcagaatatagttgattgatggagaaagtcactgaacagaggagttgcaacccagaatatctatctatctatctatttatctatctatctatctatctatctatctatctatctatctatcatctatctatcgattgagagagatggcttttcattgagtagctgaaaggtgccttcttcaattgaaaaaagtgggtagaaaggatatagtatggcacaaaagttttttggtaatggcaatagaaagactagaaacctctgctctaaggtctagattttttgtgaaaatgaaggagtatgcaatgtagggggtttgaaaagactgacaaaagtttgaaatacgttttgagaaaatggaggaaaggtgttgacaaggctagacctgcagtgatctccaaacttgagcttacatcataattgtatgaggcgctcattaaaacacagaatagaaaggacaggatgcattgagagacattctacaaaataactggtctgtactcttcaaaagtgttgaagtcacaaaactctaagaatgacagacgaactgttccaggcaaaggagaccgaagaggcacaacgacataatgcaaagcctgacccaggattttcttctgctataaatgacattattgggacaattggtgaaatctgcataaaatctgtgggtttgataacagtattgaaatggtgttcatgtcctggtcttcataactgtattggttacataagagaatgtccttgtttttaggaaatacacaccaaagtatttaataatgtaaaaaaaaacacacacacacacagaatactgagtcctacctccagagtttttgattcaacaggtctcggtggggccctgaaatgtacatttctagcaagttaccaggtgatgctaaggcagttggttcaggggatcacatcttgagaaccactagccaaaggagatagagagcaattgccagtaagtgtaaagaaggttcagctgaagttgaatgctagccaacaagtttttgaaatttttttcaagtagctatcagcaacctgggtatagagagtcagagaaggtagctggttgggttgctgggagtgttctgatctgcaaagatgaagagcaagcaaattaaattaaacgcaaattaaaagcagattaaataaaatgtcagcctgggaggcacttagttggtgctcaataaatggtagctgtttttctatgcccatgcaatagcttttgccagattctgctgccctcagcaggactagcttcatagtgatgccatctgcccctgtatttttcactgcagtcataccaggcaggcccccaaatgtcaccttagacaggtgactcttcaaatattgcatataagtcatagtgtttcaggtcactccaccaatgcataaaagcttccatattaaactaaatgggcaactgttgccttctgaatgccccaagccccttacttgtacctgtctaatgttaactaaaggttgttgcttcatggttttattatgtatatgctatgtcctatgtcgtcaaacgcaggaatcacatcccatttccatttgcctcacctgcgaacactgaagtcatctggtataggggatcgcctctgattctaatcccactattacatgagctctctttaggttcacaccaaagtcaaaggctgtatctcaaaccagacagtatttgtatagccagtgaaacaaaactgcatggagatcgcttgtcagatcacttgttcaactgttgttatgttttatgcacaaatgcatctcatatctctctacatgtcatatgaggatatgccacattcttatatagagagaatatattatatgttttgttaacctgaacccagaccatggcagcacttgctcccgaaatcacattgtacttcagatacagggaacatgctagtctctatagtgttccaattttaacactggtgctgctggactgagcacaaaccacatttaatgcacagggtgtggggtatggctatttcctatatatctaaagataaaacccctctcccatcccactaatctcacttatgcctcatgtcctagtagcaaaagcccctcaaatttcatcactaaagcaactctcccataagcaaaaccttagcagtcaaggcccttcaaacttcaatatgtatagaatggttatatacagtatttctatgtgtaagattagtcagtaacaataattgaagaactaagaacatctctggggaattgcttgaatgatttccaattattaacatggaataagatgtccagggtaacatgggaaaattataagatttttatggagaacaaagaggagtattgagctaatttctaaatagcatgcatatagacttgtggacattgcatattttagaggcagctgtcactgagatcacacctgccacttagctgcctgcagggactgtcctccaaataaccctgggtaggtggctgtgcatccaattacaccctgtgaaccagagtcccagaaatcaactatgaaaagtccctcctcaagttacaccatttacagatgcaatggaagccttttacagttttgttctaagtaggcccaataagtctactttaactgagacagtttgcagttgaggtcatctcctcaggaatttgctatggagttgctaagggggatcagtttcccggagctaaagtgaactttgctgttgtaacttgagttgaggcacataagacagctggtggtctaccaaaaggaagggaaagcatgctgaacagaataaaagcagctgtgggattcccaaacatagagtctaccacatctggcactggctggacttccaaattatctggaagttttccaggctgctgtcttctgatttcatgatcaccagtgctaaacctcctggacctggttcctctaatctttagaaccaccaattctcattcgtatgcaacgtggttggttacagctggaaactgctttttcaagatgtgcatatatgggccaaagtctctagagatcatcttacaaaaagattaccaacacttccctgttggagacatctgtctatgttgacaaagacaggtcatggtgagctaggtttgagaaggtaagcagtctacagttattggaatgttttggccatgcaaacgttttaccattctttgggagttttgttacatgaaatatcagaatggttaaataaaacatgaatttatgaatgcttgagggtggtgatggttaggagggttgctaccattttgaaaacatgggataaaaaaagtaaatcatcaaaataattacactgtactatgtatttatgtacataagtgattttataatgcatttaccagaatcttagtgatcctggagatcccatcagcatccttttaagaaaaggggataagggagaacaaagtgagaatgactcgggatactacatatgacactctacagttctgtgttgtccagtgtggtagccattagccacaggtggctatgtaaatttaaattagcattaagcaaaataaaaaccagcttctcaatcacactggctacaattgaagtactcaacagtcacacgttagtgagtatcatataggacattggagaatatagatttagaacctttctataacctcatgaagttatattgaacaacactgctacagaatttcagcttacatatataggatacatatatattccataatatatatgtatctaaaatatatatacatatttgtgtctatttttatatgtatatgtaatatatatatatattttttctcctccttaggctctgcaccgttggccacttttaccctaaaatgtcccctccatcacccccaatcccacctgactgatgttatctccttctatagactaatctgtaattctctgttccagagaattcctgtaactgtacttgttatgtggtgtccttataaggccaatcgttgatgaacaataaaactccaaagagtagttacagatgttgatggttttcttttcttgatggaggaagaaaaatatattaatgctagggtcatactttcccctcagtgtggccacaaattttatataatcttcacacacatacaaaaagatattcctcaagtgatgattacttggcttatttaggagtttacaatgtaatcacactgaaaagagtccttccatcttcaggtcccttctcattcctgcacattgtctctgtatttcaaaacttcttacaacacacacatacacacacacacacacacacacacacgaactcaccatgggtactagggtcttaaatgtgattcaaagtcttgggagctaagttaaatttgtccaaattaatatctaaacttctatttctcccagttctttttttagccaacttgaaatcaatccttgctccctggcccctcttctgctacactactccagattgatgccctgtgtaacttcctttactttcctatatcctaaattttggctaatgttctgcttattaattaatcatttcttctgagtggtagtcttatggtttgtatagactaaacatggcaaataggttacatttcgttgattaactctgatcaatcactaataactgcctgtagtgttatgttgaaaagaattcggaggccatggtcaagctcagtgggatagaatgcaataattgattagtgatgtgtgccatggacatagcagatatatgccatatattgtcatctctgaaatagattagctcgcttctatgtctattcgtcttcataccaatccatcaatccttactctctttggctcctttcacaattcacctctccagtttgatgctccttttatttttttattttttattttttatttttattttttgagatggagtctcgctctgtcttccaggctggagtgcagtggcgcgatctcagctcactgcaagctccacctcctgggttcacgccattctcctgcctcagcctccggagtagctgggactacaagcacccgccaccaagcccggctaattttttttgttattttagtagagacggtgtttcactgtgttaaccaggatggtcttgatctcctgacctcgtgatccgcccgcctcggcctcccaaagtgccagtttgatgctcctttaacatccctccccctgcttaacaggcataggcccatgagctacccatattccataaatattctacccaggcttcacggtaggcttcttgtaaactgttctgcatttggatccatccctactggggcgaaaggagggaagaagcagtctaatcttttaggatttatacagcaagtcccagtgcaccagatcatttctcttcctagacatgaatcacattttcttttaatctagccccctacaaacacatttttgatggacctccagcaaatagaaattaattaattataacttttatttcatggtacttcatcatcattactccatgtatgtattttttctatctatctagctagctatctaattataactgaacacaaataaacctaccacccaaacaagaactagaatattaacagtaatttccatctacctgcattcttcttttgtatcccatcctccatctgcctcgtcaaaggtcatcactcagtgttaccactagcccaaacagcagagattttatgcaaattagaaaaagatgcccagtcacctggtaaatattttagttagcatattatttatttatctatcaaaaatataaacatcatactcattcggtataaattatacaaatttatctcattcttgtttatggttgcacagtattccatggtgtattttctttatccagtctatctttgatgggtatttaagttgattccatatctttgctattgtgaatggtgctgcaatgaatacacacatgcatctgtctttataatagaatgatttgtattcctttgggtatataccttgtaacgggattgctgggtcaaatggtacttttgtctttaggtctctgaggaattgccacgctgtcttccacaaaggctgaactaatctacactcccaccagcaggatataactgtttctttttctctgccacctcgccagcatctgttgttttgtgactttttaataatagctattctgacagctgttagatgatatctcataaaacccaaaactaaaaaccctggaaagacaacttaggcaataccattcaggacacaggcatgggcaaagatttcatgatgaagatgacaaaagcaattgcaacaaaagcaaaaattgactaatggaatctaattagactaaagaacttctgcacagcaatagaaactatcaacagagtaaacagacagcctatagaatgggagaaaatttttgcaatctgtgcatctgacaaaggtctaatatccagcatctataaggaacttaaacaaatttacaagaaaaaaacaaacaaccccgttaaaaagtgggcaaaggacatgaacagatactttcaaaagaagacatacatgtgcccaacaatcatatgaacaacaacaaaaaaggctcaacatcactgatcattagataaaagcagttattttagatgttattagaatcaacaaagtctttcaattatcaaacttgactctcaattgttgctttcaatggaataatatgtatccatcatatttggaagaaggcactttgcttccaacagaatgtcaagcaatgtttctgcagatattgattttgttaaaaacaagtgtttaccacaatgtgtggacaattgctgaaataaagattcaaattacctgtctttggagtcaacaattttataataaacataagaaaaacatcaaacatataagatgtttaagatataaatggtctccccttaggtgcgatgcttttatgcaaggaataaactttgaaactctacttctctttggtagctctgaattctttatcctgaatttcatgtttagcattgcttggtgtaagttgaagaagaggcaaaaatgcaacaaagtcaggttacatgggcatctgggccactattcgtatagttgattcatgccttctagacctgcttgagccaattctaaattgattacttcattgtacaggggattaaatagatagctgctatgtctacttaaagttacgatgtggtggatccaataataaacagatcacaatgagaatctagcttgcaaattatcttggtatcttgtgcccagtctcaactagggcccagtagcatatcagatgacgattttcaaacagagaacatgtttttgctataaatggcatggcctccctctagagccctgaacttttgtactgttatacttctattggggccaaattaaatgctgtccctgtctcttggtggcagtaggtgcaacaatctgtcttttacttgggaaaatataccagcaggttccagaccctcctttaacttcatcaatatggcagggcgatgaatgtttatggagcttatcttccaccttttggcatacaagtatcttattgtggaatttaggggcattgctacatccagctcagcagactcagttaatatgatgtgagaaaaacaacttctcagaaatgttgagatgtttagggttcctatggactatattacatcaaagagcatgacttaacagcactgacacaagtgagtgtttgcaagctgccatattaacaaagtaattgtgaattgctttcaatcctcactatatctagcacagcaactgcaatcagaacttccagttggttaagtttacagtaatcactgtcatctgtcatgaaccatctggttttacagagttcagatgagaaaattgagaaaacagaatatatcttttaaatctttgatggtgacactaatttttgcggtgactctagaaatataatttttttgtgatttgaatgtttgccagaaggttggagtggtttcacttgtttttttttttttgtattataatggttttcatccacaggtcattgaaacaataggagaagtctttcattcttggcgtctaagaatgcatctccaaattatacactcagagaccagagaaaaagccacaatgtgggtgtgtggacccatttgacccaatataagatgggcttcagccaaaactccatttcttacctgaaccttaaagcctccatattaatcagatgaacatgatggtgttttaggacctctgtgatcaatgccacctcaaaccgtatatataacagtattagagtctgaataatttcttttccccagtctaaaagtatcctggacaaaggctgaaaaaagaaacactaaagaaatattcactttttatacttgaggtgaatcagcatgatcttgaatcaatgggtctgtgaatgacatagatctggaaactgcgtgagaagtgcaattttccatttatggcgtctgacaccaaccttctaatcaccagctttctatttctttattataacaaaatagagaaacagcctagttgaatccccatctagaaacaccatcgtctatttcagttgctgtttctatgaatcatggcatagcagtcaacagtcagtccttgctacctgccatgttaataagggttggtggctgagagttaccttgtggcctctgtaattccggaatctcttcgcccatgttggtattgatggcagtagctgcggtcatcattccggctgcagcagggaggtgcggctaatgctgcacactccgtggagccggtgggagccccgccccttgtgagttgggacgggaactccccgtttgttgctgcagctgcccaaaccgcagctgcagacccaggcctcctgctccacggagcacaaaggaaccccatcctgctgggccgggctacagccacctaaattgcggctgtggatccgagcctccctgtgctatttggagagggctgggagcaggcgggatctgccatcccaggcgaggctgtgactcccaaccaggtgcaggagctgggtgtctctgcagcctgtaacctcgggtgccccaggaaggacctccccaccccgtccctgcaggctaggggatgtcttctcatgctgcctggcctctctccactccctgcgcctgctccgatctccgagcgagggttggggcggagcccgggggggacatgaatggcagcgggatgcagctcgtggtgcctcttccagcctgccatggccgcccatggaccattgggcatgcatttcctcccctgtgaggcccataaaagccctggtatcagccagagtaggagagaggacggccagaggacgaagagggcagagatgcaatgggacaggacgaccagctacagagggggaagtacccttccgctgaatgctgcagagatgacctgctggcagacagaagctacgctctctgctgagagcttcagagacgggcagagaggtccgaatggcttgtctgcagagaggagttactctctccagggcctcctctttgctgatagctgaacagtcaaagggatgacttgcttacagagaggagctactcactcctctgagctgttttttttgttgtcgttgttgtttgtttgtttgtttgtttgttttttgagacggagtcttactctgttgctcaggctggagtgcagtggcaccgtgtcggctcactgcaactgttctaacactaaataaaactcttctacttcttcacccttcatttgtctgagaacctcattcttcctggatgcaaggcaagaactagggcaaaggtgcggccacagaggtttccagccagaaaaatcgacatcccagaaatcccgtaacagtattagagagccaatttccatggcagaatctcacagtgtcaaccatagcctacagataacagccatcagtgagctcaaagatactattgtttccatcactagtgcatgccttgtaaaaggagtcacttctggttcttctgtggtgcagactcaattggtgggttttcaagtcttacattataaatctattttaaccctctgaggttactttcttagtagatactatgccaagaaagttcagatggctcgaccttggttactataacgcatcaacatgattgggattcaaggagcccctcaaataaatattaagatcatctctaggtagccttgccagatcattaaattcaaattcacacataaagtatactaaaggaatgtggcaactgcatgccacttgtgagctgcaatttcatgtccttataaagtacattattaggacaattggtggactttgaataagtttgatagatgagtaaaaatattgcgttaatgccaatttcttcaatttgataactgtattgtcattgtaagagaatgtccttgattttaggaaacatacattgaattatttaggattaaagggcatgacatctccaacttattctcaaatagttaatatgtattatgtgctgaggaagataatagggtgaggaagaggaagagagagggaggaagggagttgggggaaggagattgacaaagcaaatatagaagcattaacatttggggaatctgaagactctttgtaccatttttgaaacttttcctaagtttttacttaattcaaaacaaaagtttaaaaatgttctgatgcataggtgaattttcccataacaataaattcttttttcagacttatattctgtcatttccttaggtcttgtaattcctttgatatttaggctatttctctctggatcagggctggcactcagttgaatcacataaaattatcttggcttgaaggatacgcttttaaggcactccaaattccaatctacatatcagtgacatcaacattctcaaaccaatgccccaggaaaggatgtgaaataaatatagtatttgaagagcaaagaaatttctctgcacttgtccacaagcaggctctcttttagggcaattacaagtttcacccctgtgttttctgcaccagccagcacacttttgacattaggcattagtctatatctggaggaactacatcatttataggaggaccttgaattggagcaaggatcattccaagtgcttctcaccaaggtaaaccactgagtgagagacccaatctgcttcttctgtcacatccacttcacttgatcctctggaaaactcaagtaccaaccccaggccaattccaagttaagaaggttgcaaaacctattacttccacttccagcttctcatttctttacattcagcccccaacttcttatatttaccctttctttagctcactcatgtcccattcatttacattccatctgaataatcagagacaatgaactgaagtgtttatggtacaatatctttgtttctcaccactttctaggccaactatacaaagaactataatataaatggggtgtgggatttcatgtgtattcctcctatgcatgctctgaagcacaatgcaaccttcattcaagatattccatgtagggaaaataatctgaactaatttttagtgctctttgccttttctaaaaggttatatctaagttcggaggagtgtacaaggtacaagggcataaaggtcaggggtacaatgggaatcttgtcttcagtattatctgtctctgtattatctggcatcactgacatgttaactattgcatctggtcctttgccatttgtcattcaagttttgctgaattggctgcctgcctgtctgaaaaaccctctaggtctggcaactgtcactgttgcttcttttttcctctccagtgcctgataattattttgttgctcccatgatcaatagaaaactatggtgttatctgaaactcacaactttttagacacataatgcttactcaagtcctgttttattcctacattctgggaaatcattctacactcccttgctctgcctcagggtcattcttacttaattttgtcctattttagtctcttactaaggtagcagatagtaatcataactacctcataggcttgctatacaaattaaatggggtgatgtatgtaaaatatttagcatagtgcctatcatagtcattagtcaataaatagtaattgttattttattgcactaatttatttgaccactcacccacctaatcaagtaaggagatgtagctatcttttggactccgcagtaattgaggcatttcagtatctccagatgctcttcaacaaactcttcaatcaccctggatcaccctaatctaatttgcctttactaaatagggacggattcttctaacacaacacagtgagccatctttcggtgtatgagaatccctgagcaaaatatctggcccaaatgcatgtttatcatggaaactatggttgttgtagatgaaggcagaaattaatcacaccacttaaggtagtattaaaagtctggaggaaccatcttacctcatgactataattatggaatttgatttttgagtctctgttctctcaaaaaggattttgagttggctcatcttttggcttttagaatcccattctaactcagaaggaaaatttcctgctttaactcttgttccagaaacacatctgtagccagaaaaccagatgacacattgctggagagaagactagcactgaacatccagtcaatccttactgttaaccaagctagagggtgttttagatatcctattgaagacaggacagcagaaaagtttttctaccagttatcctctttatatttgtctgatattttgggcactaagcaggacatactgactatgtagaacataggcagtgcttctggaagaaagcctaggtaaatcttagggctcagcttctttaagacaccataaagttatggattgaaatattgtatttatccagggctgcaaatgatagtttagcctaagggagagttctagtcatgattaagagagaagctatagatgacactgatatatctcttgaatattcattctcaagtattccagcaatatcacttcatcttttgcttgatgacccacttttgccctattctcaactcatttggtttggttggaattggcctccaccctcagctctaggaatagaccttatttggtccaagcaagtcagcactccctggctatagtgatgatcttatggattggcatgtgactagatctgaaccaatgaaaagccatgagaactttgcagagtatatatccaaaggatatgaaatcagtttgttgaagatatatctgcattcctgtgtttattgtagcattattcacaataggcaagatatggaatcaacctaaatgtccatcaacagatgaatggataaagaaaatgtggtacatatacacatgggaatattattcaggattaaaataggaaattctgtcacttgtgacaatatgaatgaacttgcaggacatttgttaagtgaaataagccagacatagaaagacaaatactgcatgatatcagttatacatagaatctcaaaaagccaaacttaatagaagtagaaagtagaatgggggttaccagaggctggggtggggtggggtttggggacagggagatgttgatcaaaaagtacaaagcttcagttagagagaaatacgttttcaagatctattgcacagcatggtaaccatagtgaataataatgtattgtagatttaaaaattgcaaaaagggtagatttttaaattacactttaagttctagggtacatgtgcacaacgcacaggtttgttacatatgtatacatgtgccatgttggtgtgctgcacccgttaactcgtcatttacattaggtatatctcctaaagctatcccacacctctgcccccaccccacgacaggcccgggtgtgtgatgttccccaccctgtgtccaagtgttctcattgttcacttcccacctatgagtgagaacatgctgtgtttgattttctgtccttgtgatagtttgcttggaatgatggtttccagcttcatccatgtccctgcaaaggacatgaactcatccttttttatggctgcatagtgttccatggtgtatatgtgccacattttcttaatccactctatcattgatggacatttgggttggttccaagtctttactattgtgaatagtgccaccataaacatatgtgtgcatgtgcctttatagcagcatgatttataatcctttgggtatatacccaataatgggatggctgggtcaaatggtatttctagttctagatccttgaggaatcgccactctgtcttccacaatggttgaactagtttacagtcccatcaacactgtaaaagcgttcctatttctccacatcctttccagcacctgttgtttcctgactttttaatgattgccattctaactggtgtgagatggtgtctcattgtggttttgatttgcatttctctgatggccagtgatcatgagcatttttttcatgtgtcttttggcagaataaatgtcttcttttgagaagtgtctgttcatatccttttcccactttttaatggggttgtttgattttttcttgtaaatgtgtttaagttcttcgtagattctggatattagccctttgccagatgggtagattgtaaaaatgttctcccattctgtaggttgcctgttcactctgatggtggtttcttttgctgtgcagaagctctttagtttaattagatcccatttgtctattttgtcttttgttgccattgcttttggtgttttaggcatgaagtccttgcccatgcctatgtcctgaatggtattgcctaggttttcttctagggtttttatggtcttaggtctaacatttaagtctctaatccatcttgaattaatttttgtataaggtgtaaggaagggatccagtttcagctttctacatatgactagccagttttcccagcaccatttattaaatagggaatcctttccccattgcttgtttttgtcaggtttgtcaaagatcagatggttgtagatgtgtggtattatttctgagggttctgttctgttccattggtctatatctctgttttggtaccagtaccatgctgttttggttactgtagccttgtaatatagtttgaagtcaggtagcgtgatgcttccagctttgttctttttgcttaggattgtcttggcaatgcgggctcttttttggttccatatgaactttaaagtagttttttttcccaattctgtgaagaaagtcattggtagcttgatggggatggcattgaatctataaattaccttgggcagtatggccattttcacgatattgattcttcctatccatgagcatggaatgttcttccatttgtttgtgtcctctttgatttcgttgagcagtggtttgtagttctccttgaagaggtccttcacatcaaaagggtagattttaaatattctcaccacgaaaaattataagtatgtgaaatgatggatatgttaattaacttgatataatcatttacaacgtgtacatatttatcaaaacatcaaattgtaccccctaaatacacacaattattatttgtcaattaaaaataaaaatttaagtaaaaataaaatatggggctgctaaaagtcttgatgaccttagtctgtatattgaaagagtcacagtgctgcttttatgccataagcccatgggtataggtgttccctgttgggagtaaagctgtatagaatcatctttatcattatttagtactttccagatgagattatctctttcacacgtttgtttaccagacatataagatttgattgaatcaaagctctggcgtgaaggtagctggagtcagagccatcttgggacaacaagagccactatcacgaggtcagatttctttttgggattggattcaaaaccacagatcaaggttgggaatctgaacagatgtaaagacattaaggaacttgacttgctattttaagggcccatatattctttcattctttttagtaagttttttactgggactgtcaacacagagaattatggaatgaattgttgaagcttttgtaaattggagggaggaagtatgattcactcctccattctggtttccgtctcatgcaaaaaatagatatggtgaactaatagctaaatgaggatcagagtatcagcttaattagtgaacaagacaagggctcagtgatcccaaaacatatgtttctcttgctaaagctggattagagaaatgtggctgtatattgagtctaaaatagcatcttcctatttccttactaaaatgagattttagggcatgcctgtgcagaaagttgtgtctattgagtatacactggcttacaaagccatctccaagggtcacaggtcttccttacacacacagtcaccagcaagagcaagaataaaaggaacaaaagtgtatatgtgtgtacgtgtgtgtgtgtgtgtgtgtgtgtttgtgtgtgtgagagagagagagagactgaccaagtctctatatggagggcatgctacaggccccgccccaagtatgcttactacacataagtgcttacacataggagcagacaactgctcacacatttaccagtatatgagtaaggcagtgaaaaggagaaagaaaaatgctaattttatttggaatcactgttactccacccatttgctgagtatggcttatggatgtcaggcaacctccaatcatgttaattactcttctttcattgggcaaaagcaagtaacggatggagagaggggcagaatttctgtcctcaacactatctttgaaaggtagaagagttgatagatgctctgtcttccatggcctggggaatggtgaggaagtgttctgtttataatactgtataatgaatctcagagagtgatgaacatttctgatttacatgagagtttcccactgtagaccctctgggtcactttgtccagaatcataagacatctttggctggagataacataggtaagaaatttcactggagtttattcaatcattattttatcttttttagtacgggtttttttgttaacccacagaagcaatattataaaggccttaaatatttaaagtttcaaagatccttgctccataaagtttatccatgaagattaataggaataagtataattttaagacagatattgtgtagagactatgatattttcatcagaggtgaaatgtccatttttgtttagcgggaaagagaagcactccatgagctgggttcaataaactagcaaaaggttttgagccctgaaggcacactaaacttgacaggaaaacagacatcgggcatcatatcaatttgctctattcatcatacaggagaattttctttccatcatgtccaaaccacttccaaatccaacacaacatttttttttttttttggaattctagactcaggggccatgtgaggcaacactaggtggtaaatgctaaaatgtaaatgtaaacgtagatgcaactttaaggtaggccaggtacccaaggcgttcattcttgtgaaagaatgatattcaccttccaagtctttcatgatcatgtagacaccaattgtcattagaaattatcaggtccccatctctcataggagtgctatggtgaaatttgtcaagaacaaaaacagaatggaatatgcaaaaactaccattcgctgaacacaggcagtttttaaggttactgtccatctatactacctcatcactgaacttccgggctattactagggatcttgggtcttttgacacctcttgaatacatttgatcatggttaaatcaggaaaggtgacagatagaagatggctttctggagaagtttctccgtataaaaatactactggggaagcaggactacagggatgatgtaataaggggtccagcataccctcgccccagccaaacaacagtttatctgatgaaaattactttaaaagcaatcattcgacagggcatggtggctcacgcctgtaatcccagcactttgggaggtcgaggcgggcggatcacgaggtcaggagatcgagaccatcctggctaacatggtgaaaccccttctgtactaaaaatacaaaaaattagccgggcatgctggcaggtgcctgtagtcccagctactcggaggctgaggcaggaaaatggcgtgaacccaggaggcggagcttgcagtgagcggagatcgcgccactgcattccagcctgggcgacagagcaagactccgtctcaaaaaataaaataaaataaaataaaataaatttttttaaaaaagcaatcattcaaagtctccgaaaatttttctaaggacatgtagaaaagggaaagaaatgtcattcaaaagaattcaaaagaatctactaaacaacagtaggaacagtgagagtctatggcatttgagccacaactcactccagtaccttttcccctttctcccagctccgtgttatggaaggtctaccctggacatgtgtaatcaagaagacagggctctttctcttccagtttccagtctcacccaggatacagtttcacccaggaggagcaggctgctggtgtttctcattcccctcagcactgtgttgaaaaagctatattccagaaaggtgtaacagaaaggactgcatctctcttctcccacccagctccactcatatgatataaacactactccaggtgtaggagactgataatactggccccaatcacctcttccctagcttgctcatagcaccagttttttctgcagggaaggataagccgagaagaccagcagctgccaccgccctccagtgtccaccatacacagaaggagtgtcactctgtgacaatacattgtacattgaaattatacaatgtatattctccaaccaaaatagaatgaaattagaaataaataagacaactaggtttggaaaattcacgagtatgtggagattcaacagcacactactaaacaaccaatgggtcaaagaagaaatcataggaatttagaaaatgctttcagatgaatgaaaatgaagacacagcaagagggagttgtagcaagatggcacaatagaagcctccactgatcatcctccccataggaacaccaaacttgacaactatctacacaaaagagcaccttcataagaaccaaaaatcaggtgagcaaccacagtacctgtttttaacttcatattgctgaaagaagcactgaagaaggtaagaaagacagttttgatttgtcaacaccacccctcccccactccccagaagtggctctgtggtgtagaaagagaatctgtgcacttgggaagggagagtgcagcaactgtgggactttgcattggaagtcagtgctgccagcactgggcaaaacagtccatgcctactgagggagcatttagaccagccctagccagaaggaaatcactcatccaaatggtaagaatgtgagttttagcaagcctcatcactataggctaaagtgcttggaggtcctaaataaacttcaaaggctgtctaggccacaaggaatgcaacacctaggcaggtcctactgctgtgctgggcttagagccagtggacgtggggggcatgtgatctagggagatgtcagctggggtggctaagggagtgctggcatcacccctcccctaaccccaggcagcacagatcacagctctaaaagagacccattccttccacttgagaagaggagaggaaggagtaaagaggattttgtttttcaacttagatactagctcagccatagtaggatagggcactgggcagagtcctgaaggccccattacaggacatagctcccagacaatatttctagacacacccggggccagaagggaacctgctgccttgaagagaaaaactcagtcctggcatgattcatcacctactaaagagcccctgggccctgaataatcagcagtggtaaccaggtagtacacatcgtgggccttgggtgatactgagacatgctggcttcagttatgacccagcacattcccagctgtggtgactatggggagagactccttctgcttgagaaaaggagagggatgaataaaggggactttttcttgtagtttaggtatcaactcagctgcagttgggggaagagcaccaagcaggctcttgtggtccctgattccaatccttggctcttagacagcttttctggacctaccctggtcagaggagagctcgctgctctgaaatatgagtcccaggcctggcagcattcaccacaagatgactgaagagccattgggcattaagtgaacatcagtggtaccctggcagtacccaccgtgggactgtggttgtgatggacatggggagagactcctccttcttctccagaacagggaggaaagagtgggaaggactttgtcttgtggttttggtgccagtttagctgcagtagagtagagcactaggcagatttctaacatttccaactccagcatctttggacctgcccagggcctgggagatctcactaccctgaaggaaaagacacaagatgggctggcttgaccacctgctgattatagagacctagggccttgaacaaacataggcggtagccaggtagtggtcacagcaggccttgagcaagacccagtgctgtgctggcttcaggtctgacacagtgtaatacgagtggtggtggccacagaagtgcttgtgtcactctaccccagctccaggaggatcagaacagagagagagagagagagagagagagagaaagagagactctgtttgtttgggagaaagtaagggaagagaaagagtctctgcctggcaatccagagcattcttccagatctaatccaagaccaccaaggtggtatctacaagtctgcaagaactacagtgttactaggcttagggtgccccctaaggcaggcatggcttagatcacaacacccaggtccttttgaatacctggaaatcctttccaagaaggataggtacaaacaagcccagatggcaaagaccacaatacatacctaactcttcaatgccacaacaccgacaaacatccacgatcatcaagaccatgcagggaaatatggtctcacaaattaactaaatgaagcaccaggggccaatcccagagagatagagatatgtgacatttcagacagagaattgaaaatagctgttttgagaaaactcaaagaaattcaagatatcacagagaaggaattcagaattctatcagacaaatttaacaaaggaattgaagtaattaaaaataatcaagcagaaattctggagatgaataatgcaattgaaatactgaagaatgcatcacagtctcttaacagcagaattgatcaagcagaaaaaagaattagtgagcttgaagacaggttatttgaaaatacacggtgagaggaaaaaaagaataaaaacattgaggcataccgacaagacctagaaaatagcctcaaaagggcaaatctaagtgttatttgcattaaagaagaggtagagagagcatcaggggtagaaagtgtattcaaagggataacaacagagaacttcccaaacttagagaaagatatcaatatccaagtacaataaatttatagaacaccaggcagattaacccaaagaagactacctcaaggcagctaataatcaaactcccaaaggtcaacgataaagaaaggatcctaaaagcagcaagagaaaagaaacaaacaacatacaatagagctcggatacctttggcagcagactttccagtagaaaccttacaggccaggagagagtggcatatttaaagtgctgaaggaaagaaacttttaccctagatgagtttgtgcagtgataacacccttcaaacattaaggagaaataaacactttcccagagaaacaaaatctgagagatttcatcagacctgtcctacaagaaatgcagaaaggagttctccaatttgaaagtaaaggatgttattatgcaataagaaaacatctgaaggtgtgaaactcactggtaatattaagtacacggaaaaaacacagaatattacaacaccgtaattgtggtgtgtaaactactgatatcttaactagaaagatgaaaagataaaccaataaaaaaataactaccacaacttttcaagacagacagtacaataagatatgcatagaaacaacagacatacagaacaatggaacagagcccagaaagaaatttgtacatctacagtgaactcatttttttacaaatatgccaaaaacatacactgggggaaaggacagtctcttcagtaaatggtgctgggaaaactggatatacatatgcagaagaaggaaactagactccatctcttgccatatacaaaaatcaaattaaaatggattaaagacttcaatctaagtcctcaaactatgaaacttttacaagaaaacattggtgaaacttttacaagaaaacattggtgaaactttccaggacattgaactgggcaaagatttcttgagtaataccccataaacacaggcaaccaaagcaaaaatgaacaaatgggatcatatcaagctaaaaagcatttgcacagcaaaggaaacaatcaacaaactaaagagacaacccacagaatgggagaaaatatttgcagactagccatttgacatggttaggctttgtgtccccacccaaatctcatattgaattgtaattcccataatccacataatccccaagtgtcaagggagagaccaggtggaggtaactggatcatgggggtagtttccccatgctgttctcatgatagtgagtgagttcccacgagatctgatggttttctaaggggctcttccgacttcactcagcacttctccttcctgccaccttgtgaagaaggtgccttactttcccttcaccttccaccgtgattctaagttccctgagggctccccagccatgctgaactatgattcaattaaacctctttctttataaattacccagtctcaggcagttctttata
